US009745631B2

(12) United States Patent
DePinho et al.

(10) Patent No.: US 9,745,631 B2
(45) Date of Patent: Aug. 29, 2017

(54) METHODS FOR DIAGNOSING AND TREATING ONCOGENIC KRAS-ASSOCIATED CANCER

(71) Applicants: Dana-Farber Cancer Institute, Inc., Boston, MA (US); Beth Israel Deaconess Medical Center, Inc., Boston, MA (US)

(72) Inventors: Ronald A. DePinho, Houston, TX (US); Lewis Cantley, Cambridge, MA (US); Alec C. Kimmelman, Weston, MA (US); Haoqiang Ying, Houston, TX (US); Costas A. Lyssiotis, Boston, MA (US)

(73) Assignees: Dana-Farber Cancer Institute, Inc., Boston, MA (US); Beth Israel Deaconess Medical Center, Inc., Boston, MA (US)

( * ) Notice: Subject to any disclaimer, the term of this patent is extended or adjusted under 35 U.S.C. 154(b) by 15 days.

(21) Appl. No.: 14/367,341

(22) PCT Filed: Dec. 19, 2012

(86) PCT No.: PCT/US2012/070631
§ 371 (c)(1),
(2) Date: Jun. 20, 2014

(87) PCT Pub. No.: WO2013/096455
PCT Pub. Date: Jun. 27, 2013

(65) Prior Publication Data
US 2015/0126580 A1 May 7, 2015

Related U.S. Application Data

(60) Provisional application No. 61/578,116, filed on Dec. 20, 2011.

(51) Int. Cl.
*C12Q 1/25* (2006.01)
*C12Q 1/68* (2006.01)
*A61K 48/00* (2006.01)
*A61K 31/436* (2006.01)
*A61K 31/4412* (2006.01)

(52) U.S. Cl.
CPC .......... *C12Q 1/6886* (2013.01); *A61K 31/436* (2013.01); *A61K 31/4412* (2013.01); *C12Q 2600/112* (2013.01); *C12Q 2600/118* (2013.01); *C12Q 2600/158* (2013.01)

(58) Field of Classification Search
None
See application file for complete search history.

(56) References Cited

U.S. PATENT DOCUMENTS

| 4,046,722 A | 9/1977 | Rowland |
| 4,046,784 A | 9/1977 | Gipson |
| 4,331,647 A | 5/1982 | Goldenberg |
| 4,348,376 A | 9/1982 | Goldenberg |
| 4,361,544 A | 11/1982 | Goldenberg |
| 4,444,744 A | 4/1984 | Goldenberg |
| 4,460,459 A | 7/1984 | Shaw et al. |
| 4,460,561 A | 7/1984 | Goldenberg |
| 4,468,457 A | 8/1984 | Goldenberg |
| 4,624,846 A | 11/1986 | Goldenberg |
| 4,814,470 A | 3/1989 | Colin |
| 4,818,709 A | 4/1989 | Primus |
| 4,857,653 A | 8/1989 | Colin |
| 4,924,011 A | 5/1990 | Denis |
| 5,034,506 A | 7/1991 | Summerton |
| 5,093,246 A | 3/1992 | Cech |
| 5,290,957 A | 3/1994 | Correa |
| 5,292,921 A | 3/1994 | Correa |
| 5,332,567 A | 7/1994 | Goldenberg |
| 5,438,072 A | 8/1995 | Bobee |
| 5,443,953 A | 8/1995 | Hansen |
| 5,541,297 A | 7/1996 | Hansen |
| 5,587,493 A | 12/1996 | Bouchard |
| 5,601,825 A | 2/1997 | Hansen |
| 5,637,288 A | 6/1997 | Goldenberg |
| 5,637,684 A | 6/1997 | Cook |
| 5,677,427 A | 10/1997 | Goldenberg |
| 5,677,437 A | 10/1997 | Teng |
| 5,686,578 A | 11/1997 | Goldenberg |
| 5,698,178 A | 12/1997 | Goldenberg |
| 5,780,607 A | 7/1998 | Goodnow, Jr. |
| 5,783,682 A | 7/1998 | Cook |
| 5,789,554 A | 8/1998 | Leung |
| 5,792,844 A | 8/1998 | Sanghvi |
| 5,811,234 A | 9/1998 | Roninson |
| 5,814,500 A | 9/1998 | Dietz |

(Continued)

FOREIGN PATENT DOCUMENTS

EP    0 253 738    1/1988
WO   WO 91/17976   11/1991

(Continued)

OTHER PUBLICATIONS

Gaglio et al (Molecular Systems Biology 7:523, Aug. 2011, including Supplementary Information).*
Nakayama et al (British Journal of Cancer (2008) 99, 2020-2028).*
Kinross et al (Mol Cancer Ther; 10(8); 1440-9, Aug. 2011).*
Krockenberger et al (Int J Gynecol Cancer 2007, 17, 101-106).*
Langbein et al (British Journal of Cancer (2006) 94, 578-585).*
Weinberg et al (Proc. Nat. Acad. Sci. USA 107(19): 8788-8793, 2010).*
http://www.ncbi.nlm.nih.gov/gene/8277, retrieved from the web on Apr. 18, 2016.*
Mitsuyama (The Hokkaido journal of medical science, (1979) 54(4): 387-400, abstract and figures only).*

(Continued)

*Primary Examiner* — Richard Schnizer
(74) *Attorney, Agent, or Firm* — Fish & Richardson P.C.

(57) ABSTRACT

Methods for diagnosing and treating cancer associated with an oncogenic Kras mutation in a subject are provided.

12 Claims, 32 Drawing Sheets

(56) References Cited

U.S. PATENT DOCUMENTS

| | | | |
|---|---|---|---|
| 5,922,302 | A | 7/1999 | Goldenberg |
| 6,187,287 | B1 | 2/2001 | Leung |
| 6,319,500 | B1 | 11/2001 | Goldenberg |
| 2005/0281745 | A1* | 12/2005 | Lee .................... A61K 51/0491 424/9.2 |
| 2008/0113360 | A1* | 5/2008 | Riker .................. C12Q 1/6886 435/6.12 |

FOREIGN PATENT DOCUMENTS

| | | |
|---|---|---|
| WO | WO 93/00928 | 1/1993 |
| WO | WO 93/00929 | 1/1993 |
| WO | WO 96/01815 | 1/1996 |
| WO | WO 96/39154 | 12/1996 |
| WO | WO 97/03211 | 1/1997 |

OTHER PUBLICATIONS

Gaglio et al., "Oncogenic K-Ras decouples glucose and glutamine metabolism to support cancer cell growth", *Molecular Systems Biology 2011*; Article No. 523; Aug. 16, 2011, pp. 1-15.

Yun et al., "Glucose Deprivation Contributes to the Development of KRAS Pathway Mutations in Tumor Cells", *Science* vol. 325, Sep. 18, 2009, pp. 1555-1559.

Chen et al., "Regulation of glut1 mRNA by Hypoxia-inducible Factor-1, Interaction Between H-ras and Hypdxia", *The Journal of Biological Chemistry*, vol. 276, No. 12, Issue of Mar. 23, 2001, pp. 9519-9525.

Ying et al., "Oncogenic Kras Maintains Pancreatic Tumors through Regulation of Anabolic Glucose Metabolism", *Cell* vol. 149, Apr. 27, 2012, pp. 656-670.

Clem et al., "Molecular Cancer Therapeutics, Small-molecule inhibition of 6-phosphofructo-2-kinase activity suppresses glycolytic flux and tumor growth", *Mol Cancer Ther* 2008, Jan. 17, 2008, pp. 110-120.

Kole et al., "Regulation of 6-Phosphofructo-l-kinase Activity in ras-Transformed Rat-1 Fibroblasts", *Archives of Biochemistry and Biophysics*, vol. 286, No. 2, May 1, 1991, pp. 586-590.

International Search Report for PCT/US2012/070631 dated May 13, 2013. 9 pages.

Aguirre et al., *Activated Kras and Ink4a/Arf deficiency cooperate to produce metastatic pancreatic ductal adenocarcinoma*, Genes Dev 17(24):3112-3126 (2003).

Arora et al., *c-Myc antisense limits rat liver regeneration and indicates role for c-Myc in regulating cytochrome P-450 3A activity*, J. Pharmacol. Exp. Ther.;292(3):921-928 (2000).

Barringer et al., *Blunt-end and single-strand ligations by Escherichia coli ligase: influence on an in vitro amplification scheme*, Gene 89(1):117 (1990).

Befroy et al., *Assessment of in vivo mitochondrial metabolism by magnetic resonance spectroscopy*, Methods in Enzymology; 457:373-393 (2009).

Belteki et al., *Conditional and inducible transgene expression in mice through the combinatorial use of Cre-mediated recombination and tetracycline induction* Nucleic Acids Res., 33(5):e51 (2005).

Bernstein et al., *Role for a bidentate ribonuclease in the initiation step of RNA interference*, Nature, 409(6818):363-366 (2001).

Brady et al., *Therapeutic and diagnostic uses of modified monoclonal antibodies*, nt. J. Rad. Oncol. Biol. Phys. 13(10):1535-1544 (1987).

Brummelkamp et al., *A system for stable expression of short interfering RNAs in mammalian cells*, Science, 296(5567):550-553 (2002).

Egholm, M., et al. *PNA Hybridizes to Complementary Oligonucleotides Obeying the Watson-Crick Hydrogen Bonding Rules*, Nature, 365(6446):566-568 (1993).

Elbashir et al., *RNA interference is mediated by 21-and 22-nucleotide RNAs*, Genes Dev. 15(2):188-200 (2001).

Elbashir, et al., *Duplexes of 21-nucleotide RNAs mediate RNA interference in cultured mammalian cells*, Nature; 411(6836): 494-498 (2001).

Engelman et al., *Effective use of PI3K and MEK inhibitors to treat mutant Kras G12D and PIK3CA H1047R murine lung cancers*, Nat Med.; 14(12):1351-1356 (2008).

Gautier et al., *Alpha-DNA. IV: Alpha-anomeric and beta-anomeric tetrathymidylates covalently linked to intercalating oxazolopyridocarbazole. Synthesis, physicochemical properties and poly (rA) binding*, Nucl. Acids Res. 15(16):6625-6641 (1987).

Gibson et al., *A novel method for real time quantitative RT-PCR*, Genome Research 6(10):995-1001, (1996).

Guatelli et al. *Isothermal, in vitro amplification of nucleic acids by a multienzyme reaction modeled after retroviral replication*, Proc. Nat. Acad. Sci. USA 87(5):1874-8 (1990).

Gupte et al., *Activation of glucose-6-phosphate dehydrogenase promotes acute hypoxic pulmonary artery contraction*, J Biol. Chem., 285(25):19561-71 (2010).

Hammond et al., *Post-transcriptional gene silencing by double-stranded RNA*, Nature Genet. 2(2):110-119 (2001).

Harris and Keshwani, Methods in Enzymology; Guide to Protein Purification, 2nd Edition; 463:57-71 (2009).

Heasman et al., *Beta-catenin signaling activity dissected in the early Xenopus embryo: a novel antisense approach*, Dev. Biol., 222(1):124-134 (2000).

Heid et al., *Real time quantitative PCR*, Genome Research 6(10):986-994 (1996).

Jepsen and Wengel, LNA-antisense rivals siRNA for gene silencing, Curr. Opin. Drug Discov. Devel., 7(2):188-194 (2004).

Johnson et al. *Somatic activation of the K-ras oncogene causes early onset lung cancer in mice*, Nature 410(6832):1111-1116 (2001).

Kawaguchi et al. *The role of the transcriptional regulator Ptf1a in converting intestinal to pancreatic progenitors*, Nat Genet 32(1):128-134 (2002).

Kwoh et al. *Transcription-based amplification system and detection of amplified human immunodeficiency virus type 1 with a bead-based sandwich hybridization format*, Proc. Natl. Acad. Sci. USA 86(4):1173-7 (1989).

Landegren et al. *A ligase-mediated gene detection technique*, Science 241(4869):1077-80 (1988).

Locasale et al. *Phosphoglycerate dehydrogenase diverts glycolytic flux and contributes to oncogenesis*, Nature Genetics; 43(9):869-874 (2011).

Marino et al. *Induction of medulloblastomas in p53-null mutant mice by somatic inactivation of Rb in the external granular layer cells of the cerebellum*, Genes Dev 14(8):994-1004 (2000).

Mata *A hexameric phosphorothioate oligonucleotide telomerase inhibitor arrests growth of Burkitt's lymphoma cells in vitro and in vivo*, Toxicol. Appl. Pharmacol. 144(1):189-197 (1997).

McManus et al., *Gene silencing in mammals by small interfering RNAs*, Nature Reviews Genetics, 3(10):737-47 (2002).

Milligan et al., *Current concepts in antisense drug design*, J. Med. Chem. 36(14):1923-1937 (1993).

Nasevicius and Ekker,*Effective targeted gene 'knockdown' in zebrafish*, Nat. Genet. 26(2):216-220 (2000).

Nielsen et al., *Sequence-selective recognition of DNA by strand displacement with a thymine-substituted polyamide*, Science 254(5037):1497-500 (1991).

Nielsen, P.E. *Triple Helix: Designing a New Molecule of Life*, Scientific American, (Dec. 2008).

Nielsen, P.E. *PNA Technology*, Mol Biotechnol. 26(3):233-48 (2004).

Paddison et al., *Short hairpin RNAs (shRNAs) induce sequence-specific silencing in mammalian cells*, Genes Dev. 16(8): 948-958 (2002).

Pastan et al. *Immunotoxins*, Cell 47(5):641-8 (1986).

Paul et al., *Effective expression of small interfering RNA in human cells*, Nature Biotechnol. 20(5):505-508 (2002).

Rocheleau et al. *Microfluidic glucose stimulation reveals limited coordination of intracellular Ca2+ activity oscillations in pancreatic islets*, Proc. Natl. Acad. Sci. U.S.A. 101(35):12899-903 (2004).

(56) References Cited

OTHER PUBLICATIONS

Rossi, *Practical ribozymes. Making ribozymes work in cells*, Current Biology 4(5):469-471 (1994).
Samstag, *Synthesis and properties of new antisense oligodeoxynucleotides containing benzylphosphonate linkages*, Antisense Nucleic Acid Drug Dev 6(3):153-156 (1996).
Sharp, *RNAi and double-strand RNA*, Genes Dev. 13(2):139-141 (1999).
Southern, *Detection of specific sequences among DNA fragments separated by gel electrophoresis*, J. Mol. Biol. 98(3):503 (1975).
Stachi-Fainaro et al., *Inhibition of vessel permeability by TNP-470 and its polymer conjugate, caplostatin*, Cancer Cell 7(3), 251-61 (2005).
Strauss-Soukup *Effects of neutralization pattern and stereochemistry on DNA bending by methylphosphonate substitutions*, Biochemistry 36(29):8692-8698 (1997).
Subramanian et al. *Gene set enrichment analysis: a knowledge-based approach for interpreting genome-wide expression profiles*, Proc Natl Acad Sci USA 102(43):15545-15550 (2005).
Sui et al., *A DNA vector-based RNAi technology to suppress gene expression in mammalian cells*, Proc. Natl. Acad. Sci. USA 99(8):5515-5520 (2002).
Summerton and Weller, *Morpholino antisense oligomers: design, preparation, and properties*, Antisense Nucleic Acid Drug Dev. 7(3):187-195 (1997).
Summerton, *Morpholino antisense oligomers: the case for an RNase H-independent structural type*, Biochim. Biophys. Acta 1489(1):141-158 (1999).
Tuschl, *RNA interference and small interfering RNAs*, Chem. Biochem, 2(4):239-245 (2001).
Vitetta et al. *Redesigning nature's poisons to create anti-tumor reagents*, Science 238(4830):1098-1104 (1987).
Watson et al. *Technology for microarray analysis of gene expression*, Curr Opin Biotechnol 9(6):609-14 (1998).
Wawrzynczak and Thorpe (in Introduction to the Cellular and Molecular Biology of Cancer, L. M. Franks and N. M. Teich, eds, Chapter 18, pp. 378-410, Oxford University Press. Oxford, 1986).
Wu and Wallace, *The ligation amplification reaction (LAR)--amplification of specific DNA sequences using sequential rounds of template-dependent ligation*, Genomics 4(4):560-569 (1989).
Yamada et al., *A real-time method of imaging glucose uptake in single, living mammalian cells*, Nature Protocols; 2:753 (2007).
Yu et al., *RNA interference by expression of short-interfering RNAs and hairpin RNAs in mammalian cells*, Proc. Natl. Acad. Sci. USA 99:6047-6052 (2002).

\* cited by examiner

FIG. 11

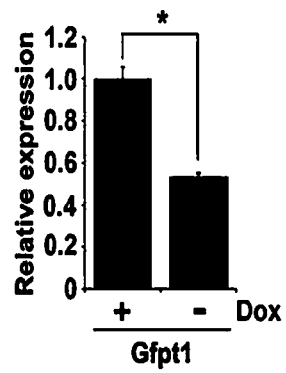
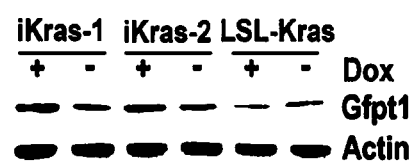
FIG. 22A
FIG. 22B
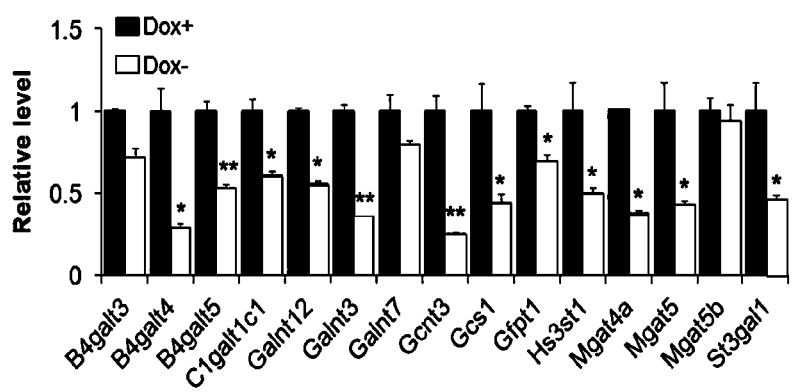
FIG. 23

METHODS FOR DIAGNOSING AND TREATING ONCOGENIC KRAS-ASSOCIATED CANCER

RELATED APPLICATIONS

This application is the National Stage of International Application Serial No. PCT/US2012/070631, filed on Dec. 19, 2012, which claims the benefit of U.S. Provisional Patent Application Ser. No. 61/578,116, filed Dec. 20, 2011, each of which is herein incorporated by reference in its entirety.

STATEMENT REGARDING FEDERALLY SPONSORED RESEARCH OR DEVELOPMENT

This invention was made with government support under grant numbers T32 CA009382, P01 CA117969, U24 CA092782, P50 CA086355, U01 CA141508, P01 CA120964, and P30 CA006516 awarded by The National Institutes of Health. The government has certain rights in the invention.

REFERENCE TO SEQUENCE LISTING

Pursuant to 37 C.F.R. 1.821(c), a sequence listing is submitted herewith via EFS-Web as an ASCII compliant text file named "Sequencelisting.TXT" that was created on Dec. 19, 2012, and has a size of 675,503 bytes. The content of the aforementioned file named "Sequencelisting.TXT" is hereby incorporated by reference in its entirety.

TECHNICAL FIELD

This invention relates to diagnosis and treatment of oncogenic Kras-associated cancers.

BACKGROUND

Constitutive $Kras^{G12D}$ signaling drives uncontrolled proliferation and enhances survival of cancer cells through the activation of its downstream signaling pathways, such as the MAPK and PI3K-mTOR pathways. To meet the increased anabolic needs of enhanced proliferation, cancer cells require both sufficient energy and biosynthetic precursors as cellular building blocks to fuel cell growth. Under normal conditions, differentiated cells primarily metabolize glucose through the mitochondrial tricarboxylic acid (TCA) cycle to drive the production of ATP to sustain basic cellular functions. In cancer cells, metabolic pathways are rewired in order to divert nutrients, such as glucose and glutamine, into anabolic pathways to satisfy the demand for cellular building blocks. Accumulating evidence indicates that the reprogramming of tumor metabolism is under the control of various oncogenes and oncogenic signals. The Ras oncogene in particular has been shown to promote glycolysis. However, the mechanisms by which oncogenic Kras coordinates the shift in metabolism to sustain tumor growth, particularly in the tumor microenvironment, and whether specific metabolic pathways are essential for Kras-mediated tumor maintenance remain areas of active investigation.

Pancreatic ductal adenocarcinoma (PDAC) is among the most lethal cancers with a 5 year survival rate of 3%-5%. Malignant progression from pancreatic intraepithelial neoplasia (PanINs) to highly invasive and metastatic disease is accompanied by the early acquisition of activating mutations in the KRAS oncogene, which occurs in greater than 90% of cases, and subsequent loss of tumor suppressors including Ink4a/Arf, p53 and Smad4. Genetically engineered mouse models (GEMM) have provided genetic evidence for the role of oncogenic Kras ($Kras^{G12D}$) as a major driver in PDAC initiation, with the aforementioned tumor suppressor genes constraining malignant progression. While shRNA-mediated extinction of Kras expression as well as pharmacological inhibition of its effectors can impair tumor growth in human PDAC lines, clinical trials of drugs targeting key components of the RAS-MAPK signaling pathway have shown meager responses. The paucity of clinical progress may relate to a number of factors including the lack of a tumor maintenance role for oncogenic Kras, redundancy in downstream signaling surrogates, suboptimal penetration of the drug into the tumor, and/or tumor plasticity owing to a myriad of genomic alterations and intratumoral heterogeneity. The poor response to MEK inhibitors may also relate to an insufficient understanding of the key downstream signaling surrogates of the Kras pathway in PDAC as well as what are the critical combinations to target.

Thus, what is needed in the art are reliable diagnostic methods and effective therapies for Kras-associated cancers.

SUMMARY OF THE INVENTION

As follows from the Background section above, there remains a need in the art for methods for diagnosing and treating oncogenic Kras-associated cancers. The present invention provides such methods as well as other, related benefits, as discussed in detail below.

Thus, in one preferred aspect, the invention provides a method for diagnosing a cancer associated with an oncogenic Kras mutation in a subject, the method comprising assaying a sample obtained from a subject suspected of having or being at risk of developing said cancer for: (1) an elevated level of expression or activity of one or more polypeptides mediating a function linked to a metabolic pathway that uses glucose or a glucose derivative as a substrate compared to a control sample, wherein an elevated level of expression or activity of said one or more polypeptides indicates that the subject has or is at risk of developing said cancer, and the level of expression or activity is regulated by oncogenic Kras; or (2) an elevated level of one or more metabolites associated with a function linked to a metabolic pathway that uses glucose or a glucose derivative as a substrate compared to a control sample, wherein an elevated level of said one or more metabolites indicates that the subject has or is at risk of developing said cancer, and the level of said one or more metabolites is regulated by oncogenic Kras.

In another preferred aspect, the invention provides, a method for determining the efficacy of a cancer therapy in a subject, wherein the cancer is associated with an oncogenic Kras mutation, the method comprising assaying a sample from a subject who is undergoing or has recently undergone a cancer therapy for: (1) a change in the level of expression or activity of one or more polypeptides mediating a function linked to a metabolic pathway that uses glucose or a glucose derivative as a substrate compared to a reference sample, wherein an increased or maintained level of expression or activity of said one or more polypeptides indicates poor efficacy and a decreased level or expression of said one or more polypeptides indicates efficacy, wherein the expression or activity is regulated by oncogenic Kras; or (2) a change in the level of one or more metabolites associated with a function linked to a metabolic pathway that uses glucose or a glucose derivative as a substrate compared to a reference sample, wherein an increased or maintained level of said one more metabolites indicates poor efficacy and a decreased level of said one or more metabolites indicates efficacy, and wherein the level of said one or more metabolites is regulated by oncogenic Kras. In certain aspects, the reference sample is a sample obtained from said subject prior to or at the beginning of treatment. In one aspect, the reference sample is a standardized control sample. In a preferred aspect, the cancer therapy is targeted to one or more Kras cellular signaling transduction pathways. In a certain aspect, the cancer therapy comprises administering to said subject one or more inhibitors of one or more of said Kras cellular signaling transduction pathways. In another preferred aspect, the inhibitor is an inhibitor of a polypeptide selected from the group consisting of phosphatidylinositol (PI) 3-kinase (PI3K), AKT1, AKT2, RAF proto-oncogene serine/threonine-protein kinase (c-RAF), BRAF, mitogen-activated or extracellular signal-regulated protein kinase kinase (MEK)1, MEK2, extracellular signal-regulated kinase (ERK)1, and ERK2. In another aspect, the inhibitor is selected from the group consisting of an shRNA, siRNA, and a small molecule. In still another aspect, said one or more polypeptides are one or more enzymes linked to a metabolic pathway that uses glucose or a glucose derivative as a substrate. In certain aspects, the subject has been previously determined or is simultaneously determined to comprise an oncogenic Kras mutation. Preferably, the Kras mutation is selected from the group consisting of Kras$^{G12D}$, Kras$^{G12V}$, Kras$^{G13D}$, Kras$^{G12C}$, Kras$^{Q61R}$, Kras$^{Q61L}$, Kras$^{Q61K}$, Kras$^{G12R}$, and Kras$^{G12C}$. In one aspect, the cancer associated with an oncogenic Kras mutation is selected from the group consisting of pancreatic cancer, non-small cell lung cancer, colorectal cancer, and biliary cancer.

In another preferred aspect, the invention provides a method for treating cancer in a subject, wherein the cancer is associated with an oncogenic Kras mutation, the method comprising administering to a subject in need thereof a therapeutically effective amount of one or more inhibitors of: (1) the expression or activity of one or more polypeptides mediating a function linked to a metabolic pathway that uses glucose or a glucose derivative as a substrate; or (2) one or more metabolites associated with a function linked to a metabolic pathway that uses glucose or a glucose derivative as a substrate; wherein the expression or activity of said one or more polypeptides and the level of said one or more metabolites is regulated by an oncogenic Kras. In certain aspects, the method further comprises administering an inhibitor of the oncogenic Kras associated with the cancer.

In certain aspects, said one or more polypeptides are one or more enzymes linked to a metabolic pathway that uses glucose or a glucose derivative as a substrate or are one or more enzymes of one or more metabolic pathways linked to a metabolic pathway that uses glucose or a glucose derivative as a substrate. In other aspects, said one or more polypeptides are one or more glucose transporter molecules.

In certain aspects, the metabolic pathway is selected from the group consisting of glycolysis, the non-oxidative arm of the pentose phosphate pathway (PPP), the hexosamine biosynthesis pathway (HBP), protein glycosylation pathway, pyrimidine/purine biosynthesis pathway, fatty acid biosynthesis pathway, and cholesterol biosynthesis pathway. In some aspects, said enzyme mediates a function in glycolysis. In another aspect, said enzyme is selected from the group consisting of HK1, HK2, PFK1, ENO1 and LDHA. In yet another aspect, said enzyme mediates a function in the non-oxidative arm of the pentose phosphate pathway. In another aspect, said enzyme is selected from the group consisting of ribose 5-phosphate isomerase A (RPIA) and ribulose-5-phosphate-3-epimerase (RPE). In still another aspect, said enzyme mediates a function in the hexosamine biosynthesis pathway and protein glycosylation pathway. In certain aspects, the enzyme is selected from the group consisting of glutamine-fructose-6-phosphate transaminase 1 (GFPT1), UDP-Gal:betaGlcNAc beta 1,4-galactosyltransferase (B4GALT) 4, B4GALT5, C1GALT1-specific chaperone 1 (C1GALT1C1), UDP-N-acetyl-alpha-D-galactosamine:polypeptide N-acetylgalactosaminyltransferase (GALNT) 12, GALNT3, glucosaminyl (N-acetyl) transferase 3, mucin type (GCNT3), mannosyl-oligosaccharide glucosidase (GCS1), heparan sulfate (glucosamine) 3-O-sulfotransferase 1 (HS3ST1), mannosyl (alpha-1,3-)-glycoprotein beta-1,4-N-acetylglucosaminyltransferase, isozyme A (MGAT4A), mannosyl (alpha-1,6-)-glycoprotein beta-1,6-N-acetyl-glucosaminyltransferase (MGAT5), and ST3 beta-galactoside alpha-2,3-sialyltransferase 1 (ST3 GAL1).

In another aspect, at least one of said one or more transporter molecules is the glucose transporter solute carrier family 2 (facilitated glucose transporter), member 1 (GLUT1/SLC2A1). In yet another aspect, said enzyme mediates a function in the pyrimidine/purine biosynthesis pathway. Preferably, said enzyme is selected from the group consisting of non-metastatic cells 6 (NME6), CTP synthase (CTPS), ectonucleoside triphosphate diphosphohydrolase 8 (ENTPD8), polymerase (DNA directed), epsilon 3 (p17 subunit) (POLE3), polymerase (DNA directed), epsilon (POLE), nudix (nucleoside diphosphate linked moiety X)-type motif 2 (NUDT2), deoxythymidylate kinase (thymidylate kinase) (DTYMK), replication factor C (activator 1) 5 (RFC5), polymerase (RNA) II (DNA directed) polypeptide C, 33 kDa (POLR2C), polymerase (RNA) II (DNA directed) polypeptide D (POLR2D), ectonucleoside triphosphate diphosphohydrolase 3 (ENTPD3), primase, DNA, polypeptide 1 (PRIM1), polymerase (RNA) II (DNA directed) polypeptide H (POLR2H), thymidine phosphorylase (ECGF1), polymerase (RNA) III (DNA directed) polypeptide G (32 kD) (POLR3G), polymerase (RNA) III (DNA directed) polypeptide G (POLR3G), polymerase (RNA) III (DNA directed) polypeptide G (POLR3G), carbamoyl-phosphate synthetase 2, aspartate transcarbamylase, and dihydroorotase (CAD), polymerase (DNA directed), delta 2, regulatory subunit (POLD2), thymidine kinase 1, soluble (TK1), uridine phosphorylase 1 (UPP1), and ribonucleotide reductase M2 (RRM2).

In still another aspect, said enzyme mediates a function in the cholesterol and fatty acid biosynthesis pathway. Preferably, the enzyme is selected from the group consisting of: sterol-C5-desaturase (ERG3 delta-5-desaturase homolog, *S. cerevisiae*)-like (SC5DL), sterol-C5-desaturase (ERG3 delta-5-desaturase homolog, *S. cerevisiae*)-like (SC5DL), mevalonate kinase (MVK), 3-hydroxy-3-methylglutaryl-CoA reductase (HMGCR), lanosterol synthase (2,3-oxidosqualene-lanosterol cyclase) (LSS), 3-hydroxy-3-methyl-glutaryl-CoA synthase 1 (soluble) (HMGCS1), mevalonate (diphospho) decarboxylase (MVD), 7-dehydrocholesterol reductase (DHCR7), phosphomevalonate kinase (PMVK), cytochrome P450, family 51, subfamily A, polypeptide 1 (CYP51A1), farnesyl-diphosphate farnesyltransferase 1 (FDFT1), farnesyl diphosphate synthase (FDPS), squalene epoxidase (SQLE), isopentenyl-diphosphate delta isomerase 1 (IDI1), and fatty acid synthase (FASN).

In another aspect, said metabolite is a product of glycolysis, the non-oxidative arm of the pentose phosphate pathway (PPP), or the hexosamine biosynthesis pathway (HBP). Preferably, said metabolite is a product of glycolysis selected from the group consisting of glucose-6-phosphate (G6P), fructose-6-phosphate (F6P), fructose-1,6-bisphosphate (FBP), phosphoenolpyruvic acid (PEP), and lactate. In one aspect, the metabolite is glucosamine-6-phosphate (GlcN6P). Preferably, the metabolite is a product of the non-oxidative arm of the PPP selected from the group consisting of sedohepulose-7-phosphate (S7P), ribose-5-phosphate (R5P), erythose-4-phosphate (E4P), xylulose-5 phosphate (X5P), and sedoheptulose 1,7-bisphosphate (SBP).

Unless otherwise defined, all technical and scientific terms used herein have the same meaning as commonly understood by one of ordinary skill in the art to which this invention pertains. In case of conflict, the present document, including definitions, will control.

All publications, patent applications, patents, and other references mentioned herein are incorporated by reference in their entirety. The materials, methods, and examples disclosed herein are illustrative only and not intended to be limiting.

The details of one or more embodiments of the invention are set forth in the accompanying drawings and the description below. Preferred methods and materials are described below, although methods and materials similar or equivalent to those described herein can also be used in the practice or testing of the present invention. Other features, objects, and advantages of the invention will be apparent from the description and drawings, and from the claims.

DESCRIPTION OF DRAWINGS

In FIG. 5, bars in each treatment group correspond to invididual tumors.

FIG. 11 shows heat maps of the genes enriched in the indicated metabolism pathways (steroid synthesis, pyrimidine synthesis, and glycan structure synthesis and O-glycosylation) and illustrate the changes in gene expression upon doxycycline withdrawal. Expression levels shown are representative of $\log_2$ values of each replicate from either xenograft tumors ("orthotopic tumors") or cultured parental cell lines ("cells"). Light gray signal denotes higher expression relative to the mean expression level within the group and dark gray signal denotes lower expression relative to the mean expression level within the group, i.e., the intensity of color is inversely proportional to the level of expression. In each group, data for each replicate is shown and arranged horizontally.

FIG. 22A is a bar graph quantifying the relative mRNA expression of Gfpt1 and FIG. 22B is a photograph of a Western blot showing the protein levels of Gfpt1 in iKras p53L/+ PDAC tumor cells (iKras-1 and iKras-2) relative to constitutive LSL-KrasG12D p53L/+ control cells (LSL-Kras) cultured in the presence or absence of doxycycline for 24 hours (Dox+ and Dox−, respectively). In FIG. 22B, actin is shown as a gel loading control.

FIG. 23 is a bar graph quantifying the relative mRNA levels of glycosylation genes (B4GALT3, B4GALT4, B4GALT5, C1GALT1C1, GALNT12, GALNT3, GALNT7, GCS1, GFPT1, HS3ST1, MGAT4A, MGAT5, MGATSB, ST3GAL1) in iKras p53L/+ cells cultured in the presence or absence of doxycycline for 24 hours (Dox+ and Dox−, respectively); statistical significance is indicated as follows: *: $p<0.05$; **: $p<0.01$.

DETAILED DESCRIPTION

Figure 1:
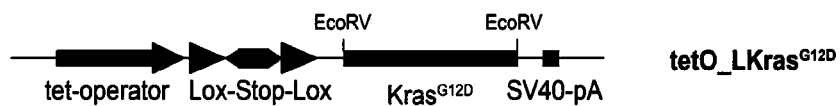
FIG. 1 is a schematic diagram depicting the construct for the tetO_Lox-Stop-Lox-KrasG12D (iKras) transgenic allele. The restriction sites (EcoRV) flanking the $Kras^{G12D}$ ORF are shown. "SV40-pA" indicates the SV40 poly(A) sequence.

Various aspects of the invention are described below.

I. Overview

Tumor maintenance relies on continued activity of driver oncogenes, although their rate-limiting role is highly context-dependent. Oncogenic Kras mutation serves a critical role in tumor initiation in a number of cancers, including, but not limited to, human pancreatic ductal adenocarcinoma (PDAC), non-small cell lung cancer, colorectal cancer, and biliary cancer. It is presently discovered, as demonstrated in the Examples herein, using an inducible Kras$^{G12D}$-driven p53 mutant PDAC mouse model of a Kras-associated cancer, that advanced PDAC remains strictly dependent on continued Kras$^{G12D}$ expression. Genome-wide analysis and metabolomic studies indicated that Kras$^{G12D}$ serves a vital role in controlling tumor metabolism through stimulation of glucose uptake and channeling of glucose intermediates into the hexosamine biosynthesis pathway (HBP) and pentose phosphate pathway (PPP). The present Examples also reveal that oncogenic Kras regulates ribose biogenesis; unlike canonical models, it is presently discovered that oncogenic Kras drives glycolysis intermediates into the non-oxidative PPP, thereby decoupling ribose biogenesis from NADP/NADPH-mediated redox control.

It is also discovered, and demonstrated in the present Examples, that tumor growth can be inhibited by the specific inhibition of RPIA and/or RPE, enzymes mediating a function in the non-oxidative arm of the PPP, indicating that the metabolic enzymes presently discovered to be regulated by oncogenic Kras in tumors can be targeted to effectively treat cancer. Thus, these and other discoveries disclosed herein provide in vivo mechanistic insights into how oncogenic Kras promotes metabolic reprogramming in native tumors, thereby facilitating diagnosis of Kras-associated cancers, e.g., by revealing a Kras-associated cancer specific expression profile of certain polypeptides and/or metabolites associated with functions linked to metabolic pathways that use glucose or a glucose derivative as a substrate, and provide novel metabolic targets for therapeutic benefit in PDAC and other Kras-associated cancers.

Thus, in one embodiment, the present invention provides a method for diagnosing a cancer associated with an oncogenic Kras mutation in a subject, the method comprising assaying a sample obtained from a subject suspected of having or being at risk of developing said cancer for: (1) an elevated level of expression or activity of one or more polypeptides mediating a function linked to a metabolic pathway that uses glucose or a glucose derivative as a substrate compared to a control sample, wherein an elevated level of expression or activity of said one or more polypeptides indicates that the subject has or is at risk of developing said cancer, and said elevated level of expression or activity is regulated by oncogenic Kras; or (2) an elevated level of one or more metabolites associated with a function linked to a metabolic pathway that uses glucose or a glucose derivative as a substrate compared to a control sample, wherein an elevated level of said one or more metabolites indicates that the subject has or is at risk of developing said cancer, and the level of said one or more metabolites is regulated by oncogenic Kras.

In another embodiment, the present invention provides a method for determining the efficacy of a cancer therapy in a subject, wherein the cancer is associated with an oncogenic Kras mutation, the method comprising assaying a sample from a subject who is undergoing or has recently undergone a cancer therapy for: (1) a change in the level of expression or activity of one or more polypeptides mediating a function linked to a metabolic pathway that uses glucose or a glucose derivative as a substrate compared to a reference sample, wherein an increased or maintained level of expression or activity of said one or more polypeptides indicates poor efficacy and a decreased level or expression of said one or more polypeptides indicates efficacy, wherein said level of expression or activity is regulated by oncogenic Kras; or (2) a change in the level of one or more metabolites associated with a function linked to a metabolic pathway that uses glucose or a glucose derivative as a substrate compared to a reference sample, wherein an increased or maintained level of said one more metabolites indicates poor efficacy and a decreased level of said one or more metabolites indicates efficacy, and wherein said level of said one or more metabolites is regulated by oncogenic Kras.

In yet another embodiment, the present invention provides a method for treating cancer in a subject, wherein the cancer is associated with an oncogenic Kras mutation, the method comprising administering to a subject in need thereof a therapeutically effective amount of one or more inhibitors of: (1) the expression or activity of one or more polypeptides mediating a function linked to a metabolic pathway that uses glucose or a glucose derivative as a substrate; or (2) one or more metabolites associated with a function linked to a metabolic pathway that uses glucose or a glucose derivative as a substrate; wherein the expression or activity of said one or more polypeptides and the level of said one or more metabolites is regulated by an oncogenic Kras.

II. Definitions

As used herein, the term "Kras-associated cancer" means a cancer in which the initiation and/or maintenance are/is dependent, at least in part, on an activating mutation in a Kras gene. Typically, an "activating mutation" is one which leads to constitutive activation of the Kras gene. As discussed above, non-limiting examples of a Kras-associated cancer include human pancreatic ductal adenocarcinoma (PDAC), non-small cell lung cancer, colorectal cancer, and biliary cancer.

As used herein, the terms "iKras$^{G12D}$" and "iKras" are abbreviated terms for and are interchangeable with "p48-Cre tetO_LKrasG12D ROSA_rtTA."

Throughout this disclosure, the following abbreviations may be used and have the following meanings: "G6P": glucose 6-phosphate; "G$\delta$L6P": 6-phosphoglucono-$\delta$-lactone; "F6P": fructose 6-phosphate; "FBP": fructose 1,6-bisphosphate; "DHAP": dihydroxyacetone phosphate; "G3P": glyceraldehyde 3-phosphate; "B(1,3)PG": 1,3-biphosphglycerate; "B(2,3)PG": 2,3-biphosphoglycerate; "3PG": 3-phosphoglycerate; "PEP": phosphoenopyruvate; "GlcN6P": glucosamine-6-phosphate; "S7P": sedoheptulose-7-phosphate; "RU5P": ribulose-5-phosphate; "R5P": ribose-5-phosphate; "E4P": erythose-4-phosphate; "X5P": xylulose-5 phosphate; "SBP": sedoheptulose 1,7-bisphosphate; "GlcNAc": N-acetylglucosamine; "GlcNAc-1P": N-acetyl-D-glucosamine-1 phosphate; "UDP-GlcNAc": uridine diphosphate (UDP) N-acetylglucosamine; "GSH": cellular reduced glutathione; and "GSSG": oxidized glutathione.

As used herein, an "inhibitor of one or more metabolites associated with a function linked to a metabolic pathway that uses glucose or a glucose derivative as a substrate" is a molecule (e.g., small molecule) that inhibits the ability of a metabolite to be a substrate for an enzymatic reaction or to be transported by a transporter molecule (e.g., by inhibiting binding or other interaction of the metabolite to the enzyme/transporter molecule), or that inhibits binding to a receptor molecule.

An "inhibitor of the expression or activity of one or more polypeptides mediating a function linked to a metabolic pathway that uses glucose or a glucose derivative as a substrate" is a molecule (e.g., antisense oligonucleotide, RNAi, or other small molecule) that inhibits expression of the polypeptide or one or more of the polypeptide's functions linked to a metabolic pathway that uses glucose or a glucose derivative as a substrate.

As used herein, the term "subject" means any animal, including mammals and, in particular, humans.

As used herein, the term "sample" includes any suitable specimen obtained from an individual for assaying the level of a polypeptide mediating a function linked to a metabolic pathway that uses glucose or a glucose derivative as a substrate and/or the level of a metabolite associated with a function linked to a metabolic pathway that uses glucose or a glucose derivative as a substrate. Non-limiting examples of suitable specimens include, e.g., tumor tissue (e.g., from a biopsy), fluid from a cyst, and blood).

As used herein, a "control sample" contains a specimen (or specimens) obtained from one or more individuals whom have been determined to not comprise an oncogenic Kras gene (e.g., Kras$^{G12D}$). As used herein, a "reference sample"

is a sample selected for comparison to a test sample. In a preferred embodiment, a reference sample is obtained from the subject prior to or at the beginning of a cancer therapy, for comparison to a sample obtained from that subject during and/or subsequent to therapy, e.g., in order to determine the efficacy of the therapy. In the latter case, it will be appreciated that the reference sample can be (and generally will be) from a subject comprising an oncogenic Kras gene. In another embodiment, the reference sample may be a "standardized control sample," which can be a sample or combination of samples obtained from one or more individuals whom have been determined to not comprise an oncogenic Kras gene (e.g., Kras$^{G12D}$).

As used herein, the term "polypeptide mediating a function linked to a metabolic pathway that uses glucose or a glucose derivative as a substrate" includes, without limitation, enzymes and transporter molecules involved in metabolic pathways. As used herein, "transporter molecules involved in metabolic pathways" are transporter molecules that transport a compound (such as, e.g., a metabolite) that: (a) is a substrate, or is a compound that is converted by one or more reactions to a substrate, for an enzyme of the relevant metabolic pathway or (b) is a product, or is a compound obtained by one or more reactions from a product, of a reaction catalyzed by an enzyme of the relevant metabolic pathway. Non-limiting examples of such metabolic pathways include, e.g., glycolysis, the pentose phosphate pathway (PPP), the hexosamine biosynthesis pathway (HBP), protein glycosylation pathway, pyrimidine/purine biosynthesis pathway, fatty acid biosynthesis pathway, and cholesterol biosynthesis pathway. It is to be understood that polypeptides disclosed herein may each be referred to by the name of the nucleic acid encoding the polypeptide or by the name of the polypeptide itself (when the two names are different from each other). Thus, for example, the polypeptide "squalene monooxygenase" may also be referred to as "squalene epoxidase (SQLE)", the name of its encoding nucleic acid, and it will be clear from the context in which the polypeptide or encoding nucleic acid is disclosed whether the polypeptide or the encoding nucleic acid is being referred to. Non-limiting examples of such polypeptides include, e.g., the enzymes HK1, HK2, PFK1, ENO1 and LDHA (mediating functions in glycolysis); RPIA AND RPE (mediating functions in the non-oxidative arm of the PPP); glutamine-fructose-6-phosphate transaminase 1 (GFPT1) (mediating a function in the HBP); B4GALT4, B4GALT5, C1GALT1C1, GALNT12, GALNT3, GCNT3, GCS1, HS3ST1, MGAT4A, MGAT5, ST3GAL1 (mediating functions in the protein glycosylation pathway); and the glucose transporter molecule GLUT1/SLC2A1.

As used herein the term "glucose derivative" includes any modified glucose molecule and, in particular, molecules derived, at least in part, directly or indirectly, via one or more metabolic pathways, from glucose, for example, but not limited to, intermediates produced by glycolysis (e.g., glucose 6-phosphate (G6P), fructose 6-phophate (F6P), fructose-1,6-bisphosphate (FBP), glyceraldehyde 3-phosphate, dihydroxyacetone phosphate, phosphoenolpyruvic acid (PEP), and lactate); metabolites of the non-oxidative arm of the PPP (e.g., sedohepulose-7-phosphate (S7P), ribose-5-phosphate (R5P), erythose-4-phosphate (E4P), xylulose-5 phosphate (X5P), and sedoheptulose 1,7-bisphosphate (SBP)), among many others.

As used herein, the term "elevated level of expression or activity" within the context of a polypeptide mediating a function linked to a metabolic pathway that uses glucose or a glucose derivative as a substrate means, with respect to "expression," an increased level of mRNA encoding the polypeptide and/or the polypeptide itself, as measured, e.g., by QPCR, Western blot, and/or other suitable assays known in the art. With respect to an elevated level of "activity," the term means one or more functions of the polypeptide, particularly a function in a metabolic pathway involving the enzyme, is increased, compared, e.g., to the function(s) in a sample lacking an oncogenic Kras.

As used herein, the term "metabolite associated with a function linked to a metabolic pathway that uses glucose or a glucose derivative as a substrate" means a product of an enzymatic reaction, or two or more sequential reactions, in a metabolic pathway that uses glucose or a glucose derivative as a substrate, or a compound that is required for such a function (e.g., a precursor compound), as well as compounds (e.g., glucose) that are transported by transporter molecules that participate indirectly in those metabolic pathways. Non-limiting examples of metabolites encompassed by the present invention include, e.g., glucose, glucose-6-phosphate (G6P), fructose-6-phosphate (F6P), fructose-1,6-bisphosphate (FBP), phosphoenolpyruvic acid (PEP), and lactate (metabolites of glycolysis); sedohepulose-7-phosphate (S7P), ribose-5-phosphate (R5P), erythose-4-phosphate (E4P), xylulose-5 phosphate (X5P), and sedoheptulose 1,7-bisphosphate (SBP) (metabolites of the non-oxidative arm of the PPP). As used herein, the term "elevated level of one or more metabolites" means that the amount of the one or more metabolites is increased compared to the amount in a control sample.

As used herein, the term "regulated by an oncogenic Kras," within the context of the level of expression or activity of a polypeptide or metabolite provided herein, means that the level of expression or activity of the polypeptide or metabolite is modulated (increased or decreased) as a result of the presence of an oncogenic Kras (compared to the level in the absence of oncogenic Kras).

As used herein, a subject "at risk of developing cancer" is a subject that has a predisposition to develop the condition (i.e., a genetic predisposition to develop a cancer such as a mutation in Kras(e.g., Kras$^{G12D}$, etc.), and/or p53 and/or Ink4a/Arf, and/or Smad4, or has been exposed to conditions that can result in the condition. Thus, a subject can be one "at risk of developing a cancer" when the subject has been exposed to mutagenic or carcinogenic levels of certain compounds (e.g., carcinogenic compounds in cigarette smoke such as acrolein, arsenic, benzene, benz{a}anthracene, benzo{a}pyrene, polonium-210 (Radon), urethane, or vinyl chloride). Moreover, the subject can be "at risk of developing a cancer" when the subject has been exposed to, e.g., large doses of ultraviolet light or X-irradiation, or exposed (e.g., infected) to a tumor-causing/associated virus such as papillomavirus, Epstein-Barr virus, hepatitis B virus, or human T-cell leukemia-lymphoma virus.

A subject "suspected of having a cancer associated with an oncogenic Kras mutation" is one having one or more symptoms of cancer. Symptoms of cancer are well-known to those of skill in the art and include, without limitation, upper abdominal pain that may radiate to a subject's back, depression, blood clots, weight loss, weakness, excessive fatigue, difficulty eating, loss of appetite, chronic cough, worsening breathlessness, coughing up blood, blood in the urine, blood in stool, nausea, vomiting, liver metastases, lung metastases, bone metastases, abdominal fullness, bloating, abdominal pain, dark urine, white stool, bile in stool, increased blood cholesterol, fluid in peritoneal cavity, constipation, abdominal distension, perforation of colon, acute peritonitis (infection, fever, or pain), pain, vomiting blood, heavy sweating, fever, high blood pressure, anemia, diarrhea, jaundice, dizziness, chills, muscle spasms, colon metastases, lung metastases, bladder metastases, liver metastases, bone metastases, kidney metastases, and pancreas metastases, difficulty swallowing, and the like.

From the above it will be clear that neither subjects "at risk of developing cancer" nor subjects "suspected of having a cancer associated with an oncogenic Kras mutation" are all the subjects within a species of interest.

As used herein, an "inhibitor of a Kras cellular signaling transduction pathway" is a compound or small molecule that reduces or prevents Kras-mediated cell signaling. It is understood that in this context "reduces" means "partially decreases" and "prevents" means "completely decreases" or "eliminates." The inhibitor of a Kras cellular signaling transduction pathway may directly target Kras and inhibit its expression or activity (e.g., an shRNA molecule or other antisense oligonucleotide); however, preferably, the inhibitor targets a downstream signaling molecule in the Kras cell signaling pathway, such as, but not limited to, phosphatidylinositol (PI) 3-kinase, m-TOR, Aid, RAF proto-oncogene serine/threonine-protein kinase (c-RAF), mitogen-activated or extracellular signal-regulated protein kinase kinase (MEK), and extracellular signal-regulated kinase (ERK). The skilled artisan will understand, however, that other downstream targets may also be suitable targets for an inhibitor of the present invention and such targets are also encompassed by the present invention. By way of non-limiting example, a specific example of a MEK1 inhibitor is PD98059; however, the skilled artisan will understand that many such inhibitors are known in the art, and will know how to select a suitable inhibitor of a desired target from the available inhibitors known in the art.

As used herein, the term "treating cancer" means causing a partial or complete decrease in the rate of growth of a tumor, and/or in the size of the tumor and/or in the rate of local or distant tumor metastasis in the presence of an inhibitor of the invention, and/or any decrease in tumor survival.

As used herein "combination therapy" means that a subject in need of treatment with a certain composition or drug is treated or given one or more other compositions or drugs for the disease in conjunction with the first and/or in conjunction with one or more other therapies, such as, e.g., a cancer therapy such as chemotherapy, radiation therapy, and/or surgery. Such combination therapy can be sequential therapy wherein the patient is treated first with one treatment modality (e.g., drug or therapy), and then the other (e.g., drug or therapy), and so on, or all drugs and/or therapies can be administered simultaneously. In either case, these drugs and/or therapies are said to be "coadministered." It is to be understood that "coadministered" does not necessarily mean that the drugs and/or therapies are administered in a combined form (i.e., they may be administered separately or together to the same or different sites at the same or different times).

The term "pharmaceutically acceptable derivative" as used herein means any pharmaceutically acceptable salt, solvate or prodrug, e.g., ester, of a compound of the invention, which upon administration to the recipient is capable of providing (directly or indirectly) a compound of the invention, or an active metabolite or residue thereof. Such derivatives are recognizable to those skilled in the art, without undue experimentation. Nevertheless, reference is made to the teaching of Burger's Medicinal Chemistry and Drug Discovery, 5th Edition, Vol 1: Principles and Practice, which is incorporated herein by reference to the extent of teaching such derivatives. Preferred pharmaceutically acceptable derivatives are salts, solvates, esters, carbamates, and phosphate esters. Particularly preferred pharmaceutically acceptable derivatives are salts, solvates, and esters. Most preferred pharmaceutically acceptable derivatives are salts and esters.

As used herein the terms "therapeutically effective" and "effective amount", used interchangeably, applied to a dose or amount refers to a quantity of a composition, compound or pharmaceutical formulation that is sufficient to result in a desired activity upon administration to an animal in need thereof. Within the context of the present invention, the term "therapeutically effective" refers to that quantity of a composition, compound or pharmaceutical formulation that is sufficient to reduce or eliminate at least one symptom of a disease or condition specified herein. When a combination of active ingredients is administered, the effective amount of the combination may or may not include amounts of each ingredient that would have been effective if administered individually. The dosage of the therapeutic formulation will vary, depending upon the nature of the disease or condition, the patient's medical history, the frequency of administration, the manner of administration, the clearance of the agent from the host, and the like. The initial dose may be larger, followed by smaller maintenance doses. The dose may be administered, e.g., weekly, biweekly, daily, semi-weekly, etc., to maintain an effective dosage level.

Therapeutically effective dosages can be determined stepwise by combinations of approaches such as (i) characterization of effective doses of the composition or compound in in vitro cell culture assays using tumor cell growth and/or survival as a readout followed by (ii) characterization in animal studies using tumor growth inhibition and/or animal survival as a readout, followed by (iii) characterization in human trials using enhanced tumor growth inhibition and/or enhanced cancer survival rates as a readout.

The term "nucleic acid hybridization" refers to the pairing of complementary strands of nucleic acids. The mechanism of pairing involves hydrogen bonding, which may be Watson-Crick, Hoogsteen or reversed Hoogsteen hydrogen bonding, between complementary nucleoside or nucleotide bases (nucleobases) of the strands of nucleic acids. For example, adenine and thymine are complementary nucleobases that pair through the formation of hydrogen bonds. Hybridization can occur under varying circumstances. Nucleic acid molecules are "hybridizable" to each other when at least one strand of one nucleic acid molecule can form hydrogen bonds with the complementary bases of another nucleic acid molecule under defined stringency conditions. Stringency of hybridization is determined, e.g., by (i) the temperature at which hybridization and/or washing is performed, and (ii) the ionic strength and (iii) concentration of denaturants such as formamide of the hybridization and washing solutions, as well as other parameters. Hybridization requires that the two strands contain substantially complementary sequences. Depending on the stringency of hybridization, however, some degree of mismatches may be tolerated. Under "low stringency" conditions, a greater percentage of mismatches are tolerable (i.e., will not prevent formation of an anti-parallel hybrid). See Molecular Biology of the Cell, Alberts et al., 3rd ed., New York and London: Garland Publ., 1994, Ch. 7.

Typically, hybridization of two strands at high stringency requires that the sequences exhibit a high degree of complementarity over an extended portion of their length. Examples of high stringency conditions include: hybridization to filter-bound DNA in 0.5 M NaHPO4, 7% SDS, 1 mM EDTA at 65° C., followed by washing in 0.1×SSC/0.1% SDS (where 1×SSC is 0.15 M NaCl, 0.15 M Na citrate) at 68° C. or for oligonucleotide (oligo) inhibitors washing in 6×SSC/0.5% sodium pyrophosphate at about 37° C. (for 14 nucleotide-long oligos), at about 48° C. (for about 17 nucleotide-long oligos), at about 55° C. (for 20 nucleotide-long oligos), and at about 60° C. (for 23 nucleotide-long oligos).

Conditions of intermediate or moderate stringency (such as, for example, an aqueous solution of 2×SSC at 65° C.; alternatively, for example, hybridization to filter-bound DNA in 0.5 M NaHPO4, 7% SDS, 1 mM EDTA at 65° C. followed by washing in 0.2×SSC/0.1% SDS at 42° C.) and low stringency (such as, for example, an aqueous solution of 2×SSC at 55° C.), require correspondingly less overall complementarity for hybridization to occur between two sequences. Specific temperature and salt conditions for any given stringency hybridization reaction depend on the concentration of the target DNA or RNA molecule and length and base composition of the probe, and are normally determined empirically in preliminary experiments, which are routine (see Southern, J. Mol. Biol. 1975; 98:503; Sambrook et al., Molecular Cloning: A Laboratory Manual, 2nd ed., vol. 2, ch. 9.50, CSH Laboratory Press, 1989; Ausubel et al. (eds.), 1989, Current Protocols in Molecular Biology, Vol. I, Green Publishing Associates, Inc., and John Wiley & Sons, Inc., New York, at p. 2.10.3). An extensive guide to the hybridization of nucleic acids is found in, e.g., Tijssen (1993) Laboratory Techniques in Biochemistry and Molecular Biology—Hybridization with Nucleic Acid Probes part I, chapt 2, "Overview of principles of hybridization and the strategy of nucleic acid probe assays," Elsevier, N.Y. ("Tijssen").

As used herein, the term "standard hybridization conditions" refers to hybridization conditions that allow hybridization of two nucleotide molecules having at least 50% sequence identity. According to a specific embodiment, hybridization conditions of higher stringency may be used to allow hybridization of only sequences having at least 75% sequence identity, at least 80% sequence identity, at least 90% sequence identity, at least 95% sequence identity, or at least 99% sequence identity.

As used herein, the phrase "under hybridization conditions" means conditions under conditions that facilitate specific hybridization of a subset of capture oligonucleotides to complementary sequences present in the cDNA or cRNA. The terms "hybridizing specifically to" and "specific hybridization" and "selectively hybridize to," as used herein refer to the binding, duplexing, or hybridizing of a nucleic acid molecule preferentially to a particular nucleotide sequence under at least moderately stringent conditions, and preferably, highly stringent conditions, as discussed above. As used herein, the term "complementary sequence," when referring to a nucleic acid sequence, refers to the nucleic acid base sequence that can form a double-stranded structure (duplex) by matching bases to bases in a reference sequence. For example, the complementary sequence to the reference sequence G-T-A-C (SEQ ID NO: 155) is C-A-T-G (SEQ ID NO: 156). Within certain embodiments, a complementary sequence can have mismatches at certain nucleic acid residues with the reference sequence. In contrast, as used herein, the "exact complement" of a reference nucleic acid sequence refers to a complementary sequence that contains no base mismatches with the reference sequence.

As used herein, the term "hybridization pattern" refers to the raw data of a microarray assay, wherein, for example, the detectably labeled nucleic acid sample (e.g., cDNA or cRNA), or detectably labeled detection probes bound to nucleic acids (cDNA or cRNA sample) hybridized to capture oligonucleotides on the array, are detected in a specific pattern of detectable signal, the specific pattern being determined by which nucleic acid targets are present in the tested sample. Hybridization patterns of different samples can also be compared visually, as long as the samples are hybridized to microarray slides having capture oligonucleotides spotted on the slides in identical locations. Hybridization patterns can be determined using, e.g., pattern recognition algorithms.

"Polypeptide" and "protein" are used interchangeably and mean any peptide-linked chain of amino acids, regardless of length or post-translational modification.

As used herein, the term "nucleic acid" or "oligonucleotide" refers to a deoxyribonucleotide or ribonucleotide in either single- or double-stranded form. The term also encompasses nucleic-acid-like structures with synthetic backbones. DNA backbone analogues provided by the invention include phosphodiester, phosphorothioate, phosphorodithioate, methylphosphonate, phosphoramidate, alkyl phosphotriester, sulfamate, 3'-thioacetal, methylene(methylimino), 3'-N-carbamate, morpholino carbamate, and peptide nucleic acids (PNAs); see Oligonucleotides and Analogues, a Practical Approach, edited by F. Eckstein, IRL Press at Oxford University Press (1991); Antisense Strategies, Annals of the New York Academy of Sciences, Volume 600, Eds. Baserga and Denhardt (NYAS 1992); Milligan (1993) J. Med. Chem. 36:1923-1937; Antisense Research and Applications (1993, CRC Press). PNAs contain non-ionic backbones, such as N-(2-aminoethyl) glycine units. Phosphorothioate linkages are described in WO 97/03211; WO 96/39154; Mata (1997) Toxicol. Appl. Pharmacol. 144:189-197. Other synthetic backbones encompassed by the term include methyl-phosphonate linkages or alternating methylphosphonate and phosphodiester linkages (Strauss-Soukup (1997) Biochemistry 36:8692-8698), and benzylphosphonate linkages (Samstag (1996) Antisense Nucleic Acid Drug Dev 6:153-156). The term nucleic acid is used interchangeably with cDNA, cRNA, mRNA, oligonucleotide, probe and amplification product.

III. Oncogenic Kras

The human Kras gene sequence has two preferred transcript variants, having the nucleic acid sequences given in GenBank Accession Nos. NM_033360 (transcript variant a) (SEQ ID NO: 1) and NM_004985.3 (transcript variant b) (SEQ ID NO: 2). The human Kras protein sequence has two preferred variants, having the amino acid sequence given in GenBank Accession Nos. NP_203524 (isoform a) (SEQ ID NO: 3) and NP_004976.2 (isoform b) (SEQ ID NO: 4). The numbering of Kras amino acid mutations (e.g., $Kras^{G12D}$, $Kras^{G61R}$, etc., corresponds to either of the above-given amino acid sequences.

Oncogenic Kras mutations associated with cancer include, without limitation, $Kras^{G12D}$, $Kras^{G12V}$, $Kras^{G13D}$, $Kras^{G12C}$, $Kras^{Q61R}$, $Kras^{Q61L}$, $Kras^{Q61K}$, $Kras^{G12R}$, and $Kras^{G12C}$. The skilled artisan will understand that a Kras gene comprising a different Kras mutation than one of those above and/or combinations of the above and/or other Kras mutations that lead to and/or do not prevent activation, and preferably constitutive activation of Kras, is also an oncogenic Kras encompassed by the present invention. In a preferred embodiment, an oncogenic Kras is $Kras^{G12D}$.

The presence of an oncogenic Kras mutation in a sample, e.g., from a cell, tumor biopsy, or other DNA, RNA or protein-containing sample can be determined at the genomic, RNA or protein level according to any suitable method known in the art.

For example, Southern blotting can be used to determine the presence of an oncogenic Kras mutation in a genome. Methods for Southern blotting are known to those of skill in the art (see, e.g., Current Protocols in Molecular Biology, Chapter 19, Ausubel, et al., Eds., Greene Publishing and Wiley-Interscience, New York, 1995, or Sambrook et al., Molecular Cloning: A Laboratory Manual, 2d Ed. vol. 1-3, Cold Spring Harbor Press, NY, 1989). In such an assay, the genomic DNA (typically fragmented and separated on an electrophoretic gel) is hybridized to a probe specific for the target region. Comparison of the intensity of the hybridization signal from the probe for the target region with control probe signal from analysis of normal genomic DNA (e.g., genomic DNA from the same or related cell, tissue, organ, etc.) provides an estimate of the relative copy number of the target nucleic acid.

Amplification-based assays, such as PCR, can also be used to determine the presence of an oncogenic Kras mutation in a genome, as well as the mRNA expression of an oncogenic Kras in an RNA-containing sample. Detailed protocols for quantitative PCR are provided, for example, in Innis et al. (1990) PCR Protocols, A Guide to Methods and Applications, Academic Press, Inc. N.Y. Real-time PCR can also be used (see, e.g., Gibson et al., Genome Research 6:995-1001, 1996; Heid et al., Genome Research 6:986-994, 1996). Real-time PCR evaluates the level of PCR product accumulation during amplification. Total genomic DNA (or RNA) is isolated from a sample. Real-time PCR can be performed, for example, using a Perkin Elmer/Applied Biosystems (Foster City, Calif.) 7700 Prism instrument. Matching primers and fluorescent probes can be designed for genes of interest using, for example, the primer express program provided by Perkin Elmer/Applied Biosystems (Foster City, Calif.). Optimal concentrations of primers and probes can be initially determined by those of ordinary skill in the art, and control (for example, beta-actin) primers and probes may be obtained commercially from, for example, Perkin Elmer/Applied Biosystems (Foster City, Calif.). To quantitate the amount of the specific nucleic acid of interest in a sample, a standard curve is generated using a control. Standard curves may be generated using the Ct values determined in the real-time PCR, which are related to the initial concentration of the nucleic acid of interest used in the assay. Standard dilutions ranging from 10-$10^6$ copies of the gene of interest are generally sufficient. In addition, a standard curve is generated for the control sequence. This permits standardization of initial content of the nucleic acid of interest in a tissue sample to the amount of control for comparison purposes. Methods of real-time quantitative PCR ("QPCR") using TaqMan probes are well known in the art. Detailed protocols for QPCR are provided, for example, for RNA in: Gibson et al., 1996, A novel method for real time quantitative RT-PCR. Genome Res., 10:995-1001; and for DNA in: Heid et al., 1996, Real time quantitative PCR. Genome Res., 10:986-994.

Other suitable amplification methods include, but are not limited to ligase chain reaction (LCR) (see Wu and Wallace (1989) Genomics 4:560, Landegren et al. (1988) Science 241:1077, and Barringer et al. (1990) Gene 89:117), transcription amplification (Kwoh et al. (1989) Proc. Natl. Acad. Sci. USA 86:1173), self-sustained sequence replication (Guatelli et al. (1990) Proc. Nat. Acad. Sci. USA 87:1874), dot PCR, and linker adapter PCR, etc. In another embodiment, DNA sequencing may be used to determine the presence of an oncogenic Kras mutation in a genome. Methods for DNA sequencing are known to those of skill in the art.

IV. Polypeptides of the Invention

Non-limiting examples of polypeptides mediating a function linked to a metabolic pathway that uses glucose or a glucose derivative as a substrate include enzymes mediating a function linked to glycolysis, the non-oxidative arm of the pentose phosphate pathway (PPP), the hexosamine biosynthesis pathway (HBP), protein glycosylation pathway, pyrimidine/purine biosynthesis pathway, the cholesterol biosynthesis pathway, the fatty acid biosynthesis pathway, as well as transporter molecules, such as, e.g., glucose transporter molecules. More particularly, non-limiting examples include, e.g., HK1, HK2, PFK1, ENO1 and LDHA (enzymes mediating a function in glycolysis); RPIA and RPE (enzymes mediating a function in the non-oxidative arm of the PPP); glutamine-fructose-6-phosphate transaminase 1 (GFPT1) (an enzyme mediating a function in the HBP); B4GALT4, B4GALT5, C1GALT1C1, GALNT12, GALNT3, GCNT3, GCS1, HS3ST1, MGAT4A, MGAT5, ST3GAL1 (enzymes mediating a function in the protein glycosylation pathway); NME6, CTPS, ENTPD8, POLE3, POLE, NUDT2, DTYMK, RFC5, POLR2C, POLR2D, ENTPD3, PRIM1, POLR2H, ECGF1, POLR3G, POLD4, DCTD, CAD, POLD2, TK1, UPP1, and RRM2 (enzymes mediating a function in the pyrimidine/purine biosynthesis pathway); SC5DL, SC4MOL, MVK, HMGCR, LSS, HMGCS1, MVD, DHCR7, PMVK, CYP51A1, FDFT1, FDPS, SQLE, and IDI1 (enzymes mediating a function in the cholesterol biosynthesis pathway); FASN (an enzyme mediating a function in fatty acid biosynthesis pathway) and GLUT1/Slc2a1 (a molecule for the transportation of glucose across cell membrane). Exemplary GenBank® Accession Numbers for the human nucleic acid and amino acid sequences of the preceding genes are provided in Table 1, below. In some instances, when multiple transcript variants are known, only one exemplary variant sequence is set forth in the table, although it is to be understood that other transcript variants are also intended be encompassed by the present invention. In certain instances, multiple transcript variants are exampled for a polypeptide; however when other transcript variants are also known, but not exemplified below, they are encompassed by the present invention. In other words, the exemplary GenBank® Accession numbers (and corresponding sequences) set forth in Table 1 are not limiting. Further, abbreviations for genes and/or polypeptides given in Table 1 are not necessarily exhaustive, and the genes and/or polypeptides may also be known in the art by other names.

TABLE 1

Exemplary GenBank® Accession Numbers

| SIN | Gene Name | Nucleic Acid GenBank® Accession No. | SIN | Corresponding Polypeptide Name | Amino Acid GenBank® Accession No. |
|---|---|---|---|---|---|
| 5 | hexokinase 1(HK1) | NM_000188 | 6 | hexokinase-1 isoform HKI | NP_000179 |
| 7 | hexokinase-2 (HK2) | NM_000189 | 8 | hexokinase-2 (HK2) | NP_000180 |
| 9 | Phosphofructokinase, liver (PFKL) | NM_002626 | 10 | 6-phosphofructokinase, liver type | NP_002617 |
| 11 | enolase 1, (alpha) (ENO1) | NM_001428 | 12 | alpha-enolase isoform 1 | NP_001419 |
| 13 | lactate dehydrogenase A (LDHA) | NM_005566 | 14 | L-lactate dehydrogenase A chain isoform 1 | NP_005557 |
| 15 | ribose 5-phosphate isomerase A (RPIA) | NM_144563 | 16 | ribose-5-phosphate isomerase | NP_653164 |
| 17 | ribulose-5-phosphate-3-epimerase (RPE) | NM_199229 | 18 | ribulose-phosphate 3-epimerase isoform 1 | NP_954699 |
| 19 | glutamine-fructose-6-phosphate transaminase 1 (GFPT1) | NM_001244710 | 20 | glucosamine--fructose-6-phosphate aminotransferase [isomerizing] 1 isoform 1 | NP_001231639 |
| 21 | UDP-Gal: betaGlcNAc beta 1,4-galactosyltransferase, polypeptide 4 (B4GALT4) | NM_003778 | 22 | beta-1,4-galactosyltransferase 4 | NP_003769 |
| 23 | UDP-Gal: betaGlcNAc beta 1,4-galactosyltransferase, polypeptide 5 (B4GALT5) | NM_004776 | 24 | beta-1,4-galactosyltransferase 5 | NP_004767 |
| 25 | C1GALT1-specific chaperone 1 (C1GALT1C1) | NM_152692 | 26 | C1GALT1-specific chaperone 1 | NP_689905 |
| 27 | UDP-N-acetyl-alpha-D-galactosamine: polypeptide N-acetylgalactosaminyl-transferase 12 (GalNAc-T12) (GALNT12) | NM_024642 | 28 | polypeptide N-acetylgalactosaminyl-transferase 12 | NP_078918 |
| 29 | UDP-N-acetyl-alpha-D-galactosamine: polypeptide N-acetylgalactosaminyl-transferase 3 (GalNAc-T3) (GALNT3) | NM_004482 | 30 | polypeptide N-acetylgalactosaminyl-transferase 3 | NP_004473 |
| 31 | glucosaminyl (N-acetyl) transferase 3, mucin type (GCNT3) | NM_004751 | 32 | beta-1,3-galactosyl-O-glycosyl-glycoprotein beta-1,6-N-acetylglucosaminyl-transferase 3 | NP_004742 |
| 33 | mannosyl-oligosaccharide glucosidase (MOGS) (GCS1)(CDG2B) | NM_006302 | 34 | mannosyl-oligosaccharide glucosidase isoform 1 | NP_006293 |
| 35 | heparan sulfate (glucosamine) 3-O-sulfotransferase 1 (HS3ST1) | NM_005114 | 36 | heparan sulfate glucosamine 3-O-sulfotransferase 1 precursor | NP_005105 |
| 37 | mannosyl (alpha-1,3-)-glycoprotein beta-1,4-N-acetylglucosaminyl-transferase, isozyme A (MGAT4A) | NM_012214 | 38 | alpha-1,3-mannosyl-glycoprotein 4-beta-N-acetylglucosaminyl-transferase A isoform 1 | NP_036346 |
| 39 | mannosyl (alpha-1,6-)-glycoprotein beta-1,6-N-acetyl-glucosaminyltransferase (MGAT5) | NM_002410 | 40 | alpha-1,6-mannosyl-glycoprotein 6-beta-N-acetylglucosaminyl-transferase A | NP_002401 |
| 41 | ST3 beta-galactoside alpha-2,3-sialyltransferase 1 (ST3GAL1) | NM_003033 | 42 | CMP-N-acetylneuraminate-beta-galactosamide-alpha-2,3-sialyltransferase 1 | NP_003024 |
| 43 | non-metastatic cells 6, protein expressed in (nucleoside-diphosphate kinase) (NME6) | NM_005793 | 44 | nucleoside diphosphate kinase 6 | NP_005784 |
| 45 | Homo sapiens CTP synthase (CTPS) | NM_001905 | 46 | CTP synthase 1 | NP_001896 |
| 47 | ectonucleoside triphosphate diphosphohydrolase 8 (ENTPD8) | NM_198585 | 48 | ectonucleoside triphosphate diphosphohydrolase 8 isoform 2 | NP_940987 |

TABLE 1-continued

Exemplary GenBank® Accession Numbers

| SIN | Gene Name | Nucleic Acid GenBank® Accession No. | SIN | Corresponding Polypeptide Name | Amino Acid GenBank® Accession No. |
|---|---|---|---|---|---|
| 49 | polymerase (DNA directed), epsilon 3 (p17 subunit) (POLE3), | NM_017443 | 50 | DNA polymerase epsilon subunit 3 | NP_059139 |
| 51 | polymerase (DNA directed), epsilon (POLE) | NM_006231 | 52 | DNA polymerase epsilon catalytic subunit A | NP_006222 |
| 53 | nudix (nucleoside diphosphate linked moiety X)-type motif 2 (NUDT2), | NM_001161 | 54 | bis(5'-nucleosyl)-tetraphosphatase [asymmetrical] | NP_001152 |
| 55 | Homo sapiens deoxythymidylate kinase (thymidylate kinase) (DTYMK) | NM_012145 | 56 | thymidylate kinase isoform 1 | NP_036277 |
| 57 | Homo sapiens replication factor C (activator 1) 5, 36.5 kDa (RFC5) | NM_007370 | 58 | replication factor C subunit 5 isoform 1 | NP_031396 |
| 59 | polymerase (RNA) II (DNA directed) polypeptide C, 33 kDa (POLR2C), | NM_032940 | 60 | DNA-directed RNA polymerase II subunit RPB3 | NP_116558 |
| 61 | polymerase (RNA) II (DNA directed) polypeptide D (POLR2D) | NM_004805 | 62 | DNA-directed RNA polymerase II subunit RPB4 | NP_004796 |
| 63 | ectonucleoside triphosphate diphosphohydrolase 3 (ENTPD3) | NM_001248 | 64 | ectonucleoside triphosphate diphosphohydrolase 3 | NP_001239 |
| 65 | primase, DNA, polypeptide 1 (49 kDa) (PRIM1) | NM_000946 | 66 | DNA primase small subunit | NP_000937 |
| 67 | polymerase (RNA) II (DNA directed) polypeptide H (POLR2H) | NM_006232 | 68 | DNA-directed RNA polymerases I, II, and III subunit RPABC3 | NP_006223 |
| 69 | thymidine phosphorylase (TYMP) (ECGF1) | NM_001953 | 70 | thymidine phosphorylase precursor | NP_001944 |
| 71 | polymerase (RNA) III (DNA directed) polypeptide G (32 kD) (POLR3G) | NM_006467 | 72 | DNA-directed RNA polymerase III subunit RPC7 | NP_006458 |
| 73 | polymerase (DNA-directed), delta 4 (POLD4) | NM_021173 | 74 | DNA polymerase delta subunit 4 | NP_066996 |
| 75 | dCMP deaminase (DCTD) | NM_001012732 | 76 | deoxycytidylate deaminase isoform a | NP_001012750 |
| 77 | carbamoyl-phosphate synthetase 2, aspartate transcarbamylase, and dihydroorotase (CAD) | NM_004341 | 78 | CAD protein | NP_004332 |
| 79 | polymerase (DNA directed), delta 2, regulatory subunit 50 kDa (POLD2) | NM_006230 | 80 | DNA polymerase delta subunit 2 | NP_006221 |
| 81 | thymidine kinase 1, soluble (TK1) | NM_003258 | 82 | thymidine kinase, cytosolic | NP_003249 |
| 83 | uridine phosphorylase 1 (UPP1) | NM_003364 | 84 | uridine phosphorylase 1 | NP_003355 |
| 85 | ribonucleotide reductase M2 (RRM2) | NM_001034 | 86 | ribonucleoside-diphosphate reductase subunit M2 isoform 2 | NP_001025 |
| 87 | sterol-C5-desaturase (ERG3 delta-5-desaturase homolog, S. cerevisiae)-like (SC5DL) | NM_006918 | 88 | lathosterol oxidase | NP_008849 |
| 89 | methylsterol monooxygenase 1 (MSMO1) (SC4MOL) | NM_006745 | 90 | methylsterol monooxygenase 1 isoform 1 | NP_006736 |
| 91 | mevalonate kinase (MVK) | NM_000431 | 92 | mevalonate kinase | NP_000422 |
| 93 | 3-hydroxy-3-methylglutaryl-CoA reductase (HMGCR) | NM_000859 | 94 | 3-hydroxy-3-methylglutaryl-Coenzyme A reductase isoform 1 | NP_000850 |
| 95 | lanosterol synthase (2,3-oxidosqualene-lanosterol cyclase) (LSS) | NM_002340 | 96 | lanosterol synthase isoform 1 | NP_002331 |

TABLE 1-continued

Exemplary GenBank ® Accession Numbers

| SIN | Gene Name | Nucleic Acid GenBank ® Accession No. | SIN | Corresponding Polypeptide Name | Amino Acid GenBank ® Accession No. |
|---|---|---|---|---|---|
| 97 | 3-hydroxy-3-methylglutaryl-CoA synthase 1 (soluble) (HMGCS1) | NM_002130 | 98 | hydroxymethylglutaryl-CoA synthase, cytoplasmic | NP_002121 |
| 99 | mevalonate (diphospho) decarboxylase (MVD) | NM_002461 | 100 | diphosphomevalonate decarboxylase | NP_002452 |
| 101 | 7-dehydrocholesterol reductase (DHCR7) | NM_001360 | 102 | 7-dehydrocholesterol reductase | NP_001351 |
| 103 | phosphomevalonate kinase (PMVK) | NM_006556 | 104 | phosphomevalonate kinase | NP_006547 |
| 105 | cytochrome P450, family 51, subfamily A, polypeptide 1 (CYP51A1) | NM_000786 | 106 | lanosterol 14-alpha demethylase isoform 1 precursor | NP_000777 |
| 107 | farnesyl-diphosphate farnesyltransferase 1 (FDFT1) | NM_004462 | 108 | squalene synthase | NP_004453 |
| 109 | farnesyl diphosphate synthase (FDPS) | NM_002004 | 110 | farnesyl pyrophosphate synthase isoform a | NP_001995 |
| 111 | squalene epoxidase (SQLE) | NM_003129 | 112 | squalene monooxygenase | NP_003120 |
| 113 | isopentenyl-diphosphate delta isomerase 1 (IDI1) | NM_004508 | 114 | isopentenyl-diphosphate Delta-isomerase 1 | NP_004499 |
| 157 | fatty acid synthase (FASN) | NM_004104.4 | 158 | fatty acid synthase | NP_004095.4 |
| 115 | solute carrier family 2 (facilitated glucose transporter), member 1 (GLUT1/SLC2A1) | NM_006516.2 | 116 | solute carrier family 2, facilitated glucose transporter member 1 | NP_006507.2 |

Enzymes mediating a function in glycolysis, the HBP and protein glycosylation, the PPP, pyrimidine/purine biosynthesis pathway, fatty acid biosynthesis pathway, cholesterol biosynthesis pathway and glucose transporter molecules are reviewed in detail in Berg, J. M. et al. Biochemistry (Textbook) ISBN-10: 0716787245|ISBN-13: 978-0716787242|Publication Date: May 19, 2006|Edition: Sixth Edition.

In certain embodiments, it is desirable to assay the level of expression or activity of one or more polypeptides mediating a function linked to a metabolic pathway that uses glucose or a glucose derivative as a substrate. The expression level of a polypeptide according to the present invention may be determined according to any suitable method known in the art. A non-limiting example of such a method includes PCR, e.g., real-time quantitative PCR (QPCR), as described in detail above, which measures the expression level of the mRNA encoding the polypeptide. As described in detail in the Examples, below, mRNA expression can also be determined using microarray (transcriptomic analysis), methods for which are well known in the art (see, e.g., Watson et al. Curr Opin Biotechnol (1998) 9: 609-14). For example, mRNA expression profiling can be performed to identify differentially expressed genes, wherein the raw intensities determined by microarray are log 2-transformed and quantile normalized and gene set enrichment analysis (GSEA) is performed according, e.g., to Subramanian et al. (2005) Proc Natl Acad Sci USA 102:15545-15550).

Other examples of suitable methods include Western blot, ELISA and/or immunohistochemistry, which can be used to measure protein expression level. Such methods are well known in the art.

Methods for assaying the level of activity of a polypeptide of the present invention include functional in vitro assays and are well known in the art. For example, and without limitation, the activity of virtually any enzyme can be traced using isotopically labeled molecules and standards (e.g. by MS, HPLC, NMR). More straightforward methods rely on coupling the activity of a desired enzyme to those with a readily observable readout (like NAD/NADH). Examples of such assays are described, for example, in Harris and Keshwani (2009), Methods in Enzymology; Guide to Protein Purification, 2nd Edition; 463:57-71; Rossomando, E. F. (1990) Methods in Enzymology; Guide to Protein Purification, 2nd Edition; 182:38-49; Crutchfield et al. (2010) Methods in Enzymology; Guide to Protein Purification, 2nd Edition; 470:393-426; Befroy et al. (2009) Methods in Enzymology; Guide to Protein Purification, 2nd Edition; 457:373-393; and Bartlett and Causey (1988) Methods in Enzymology; Guide to Protein Purification, 2nd Edition; 166:79-92. A non-limiting example includes the G6PD activity assay, as described in Gupte et al., JBC (2010) 285: 19561-71. Methods for assaying the level of activity of a glucose transporter molecule include, e.g., measuring glucose uptake using 2-[N-(7-Nitrobenz-2-Oxa-1,3-Diazol-4-yl)Amino]-2-Deoxy-D-Glucose (2NBDG), which is a fluorescent indicator for the direct monitoring of glucose uptake into living cells (see, e.g., Yamada et al. (2007) Nature Protocols; 2:753 (Chem. Synthesis of 2-NDBG & Protocols for Measurement); and Rocheleau et al. (2004) Proc. Natl. Acad. Sci. U.S.A. 101:12899 (Monitoring of Glucose Uptake by using 2-NBDG and NAD(P)H Response in Islet).

V. Metabolites of the Invention

Non-limiting examples of metabolites associated with a function linked to a metabolic pathway that uses glucose or a glucose derivative as a substrate according to the present invention include, e.g., products of glycolysis, the nonoxidative arm of the pentose phosphate pathway (PPP), or the hexosamine biosynthesis pathway (HBP), More particularly, such metabolites include, for example, and without limitation, glucose-6-phosphate (G6P), fructose-6-phosphate (F6P), fructose-1,6-bisphosphate (FBP), phosphoenolpyruvic acid (PEP), and lactate (products of glycolysis); glucosamine-6-phosphate (GlcN6P) (a product of the HBP); and sedoheptulose-7-phosphate (S7P), ribose-5-phosphate (R5P), erythose-4-phosphate (E4P), xylulose-5 phosphate (X5P), and sedoheptulose 1,7-bisphosphate (SBP) (products of the non-oxidative arm of the PPP). Metabolites of the HBP and protein glycosylation pathway, the pyrimidine/purine biosynthesis pathway, fatty acid biosynthesis pathway, and the cholesterol biosynthesis pathway are well known in the art, and are also targets of the present invention for the treatment of Kras-associated cancer. Those metabolites are described, e.g., in Berg, J. M. et al. *Biochemistry* (supra).

In certain embodiments, it is desirable to measure the levels of one or more such metabolites in a sample. Metabolite levels may be measured according to any suitable method known in the art. For example, metabolite levels may be measured as described in the materials and methods of the present Examples, using targeted liquid-chromatography mass spectrometry (LC/MS/MS). In particular, for metabolite collection, media from technical triplicates (in 10 cm dishes at ~70% confluence) was fully aspirated and 4 mL of 80% (v/v) methanol was added at dry ice temperatures. Cells and the metabolite-containing supernatants were collected into conical tubes. Insoluble material in lysates was centrifuged at 2,000×g for 15 min, and the resulting supernatant was evaporated using a refrigerated speed vac. Subsequent metabolite analysis was performed as described before (see, Locasale et al. (2011) Nature Genetics; 43:869-874). Peak areas from the total ion current for each metabolite multiple reaction monitoring (MRM) transition were integrated using MultiQuant v1.1 software (Applied Biosystems). Data analysis was performed in Cluster3.0 and TreeViewer.

The skilled artisan will understand, however, that other methods are known in the art and may be used for measuring the levels of metabolites in a sample.

VI. Methods of Diagnosis and Treatment

In certain embodiments, the present invention provides a method for diagnosing a cancer associated with an oncogenic Kras mutation in a subject, the method comprising assaying a sample obtained from a subject suspected of having or being at risk of developing said cancer for: (1) an elevated level of expression or activity of one or more polypeptides mediating a function linked to a metabolic pathway that uses glucose or a glucose derivative as a substrate compared to a control sample, wherein an elevated level of expression or activity of said one or more polypeptides indicates that the subject has or is at risk of developing said cancer, and the level of expression or activity is regulated by oncogenic Kras; or (2) an elevated level of one or more metabolites associated with a function linked to a metabolic pathway that uses glucose or a glucose derivative as a substrate compared to a control sample, wherein the level of said one or more metabolites indicates that the subject has or is at risk of developing said cancer, and said elevated level is regulated by oncogenic Kras.

It is to be understood that, in certain embodiments, the expression and/or activity level of multiple (2 or more) polypeptides and/or the level of multiple (2 or more) metabolites disclosed above may be determined in order to make the diagnosis. Any combination of polypeptides and/or metabolites may be assayed according to the present methods. Of course, in certain embodiments, the level of expression or activity of a single polypeptide or the level of a single metabolite may also be assayed.

Typically, a subject is diagnosed as having or being at risk of developing the Kras-associated cancer when the level of expression or activity of the polypeptide or the level of the metabolite, examples of which are described in detail above, is elevated by a fold-change of at least 2, at least 2.5, at least 3, at least 3.5, at least 4, at least 4.5 fold, at least 5, at least 5.5, at least 6, at least 6.5, at least 7, at least 7.5, at least 8, at least 8.5, at least 9, at least 9.5, at least 10, at least 15, at least 20, or more, compared to the control sample.

It is to be understood that in certain embodiments, a subject is diagnosed as having or being at risk of developing a Kras-associated cancer when the level of expression or activity of the polypeptide or the level of the metabolite, examples of which are described in detail above, is decreased, relative to the control. Thus, in certain embodiments, a subject may be diagnosed as having or being at risk of developing the Kras-associated cancer when the level of expression or activity of the polypeptide or the level of the metabolite, examples of which are described in detail above, is decreased by a fold-change of at least 2, at least 2.5, at least 3, at least 3.5, at least 4, at least 4.5 fold, at least 5, at least 5.5, at least 6, at least 6.5, at least 7, at least 7.5, at least 8, at least 8.5, at least 9, at least 9.5, at least 10, at least 15, at least 20, or more, compared to the control sample.

A subject may be diagnosed as "at risk" of developing an oncogenic Kras-associated cancer, rather than as "having" the cancer, e.g., if the subject does not have additional mutations typically thought to be necessary for the development of the cancer (e.g., tumor suppressor gene mutations in, e.g., p53, Ink4a/Arf, and Smad4). A subject's physician will understand how to make this determination based on the genetic profile of the subject.

In certain embodiments, the present invention provides a method for treating cancer in a subject, wherein the cancer is associated with an oncogenic Kras mutation. In a preferred embodiment, the method comprises administering to a subject in need thereof a therapeutically effective amount of one or more inhibitors of: (1) the expression or activity of one or more polypeptides mediating a function linked to a metabolic pathway that uses glucose or a glucose derivative as a substrate; or (2) one or more metabolites associated with a function linked to a metabolic pathway that uses glucose or a glucose derivative as a substrate; wherein the expression or activity of said one or more polypeptides and the level of said one or more metabolites is regulated by an oncogenic Kras.

In a preferred embodiment, the inhibitor inhibits an enzyme mediating a function linked to glycolysis, the non-oxidative arm of the pentose phosphate pathway (PPP), the hexosamine biosynthesis pathway (HBP), protein glycosylation pathway, pyrimidine/purine biosynthesis pathway, or the cholesterol and fatty acid biosynthesis pathway, or is an inhibitor of a transporter molecule, such as, e.g., a glucose transporter molecule. In a particularly preferred embodiment, an inhibitor targets the expression or activity of an enzyme selected from the group consisting of HK1, HK2, PFK1, ENO1, LDHA, RPIA and RPE, glutamine-fructose-6-phosphate transaminase 1 (GFPT1), B4GALT4, B4GALT5, C1GALT1C1, GALNT12, GALNT3, GCNT3, GCS1, HS3ST1, MGAT4A, MGAT5, ST3GAL1, NME6, CTPS, ENTPD8, POLE3, POLE, NUDT2, DTYMK, RFC5, POLR2C, POLR2D, ENTPD3, PRIM1, POLR2H, ECGF1, POLR3G, POLD4, DCTD, CAD, POLD2, TK1, UPP1, RRM2, SC5DL, SC4MOL, MVK, HMGCR, LSS, HMGCS1, MVD, DHCR7, PMVK, CYP51A1, FDFT1, FDPS, SQLE, IDI1, FASN, and GLUT1/SLC2A1.

Methods for designing inhibitors of enzymes such as those above are well known in the art. A few non-limiting examples of such inhibitors include atorvastatin for the inhibition of HMGCR, and 2-deoxyglucose for the inhibition of HK1 and HK2.

In other embodiments, the inhibitor targets a metabolite which is a product of glycolysis, the non-oxidative arm of the pentose phosphate pathway (PPP), or the hexosamine biosynthesis pathway (HBP). Preferably, an inhibitor according to the present invention decreases the levels of a metabolite selected from the group consisting of glucose-6-phosphate (G6P), fructose-6-phosphate (F6P), fructose-1,6-bisphosphate (FBP), phosphoenolpyruvic acid (PEP), and lactate (products of glycolysis); glucosamine-6-phosphate (GlcN6P) (a product of the HBP); and sedoheptulose-7-phosphate (S7P), ribose-5-phosphate (R5P), erythose-4-phosphate (E4P), xylulose-5 phosphate (X5P), and sedoheptulose 1,7-bisphosphate (SBP) (products of the non-oxidative arm of the PPP).

Design of inhibitors of metabolites of the invention, such as, e.g., those described above, will depend on the specific metabolite being targeted. Non-limiting examples of such inhibitors include, e.g., small molecules and non-functional binding proteins, which can trap the metabolite and prevent its function. The skilled artisan will understand how to design such inhibitors, based on methods well known in the art.

In one embodiment, 2 or more inhibitors targeted to a polypeptide (e.g. enzyme or transporter molecule mediating a function linked to a metabolic pathway that uses glucose or a glucose derivative as a substrate and/or metabolite of the invention are coadministered to a subject in need of treatment. In other embodiments, 3 or more, 4 or more, or 5 or more inhibitors are coadministered to as subject in need of treatment. As discussed above, coadministration can include sequential or simultaneous administration to the same or different sites, in the same or different amounts, as determined to be appropriate, e.g., by the subject's physician.

In certain embodiments, a subject has been previously determined or is simultaneously determined to comprise an oncogenic Kras mutation, such as, e.g., $Kras^{G12D}$, $Kras^{G12V}$, $Kras^{G13D}$, $Kras^{G12C}$, $Kras^{Q61R}$, $Kras^{Q61L}$, $Kras^{Q61K}$, $Kras^{G12R}$, or $Kras^{G12C}$.

Cancers associated with an oncogenic Kras mutation that may be treated according to the present invention, include, e.g., pancreatic cancer, non-small cell lung cancer, colorectal cancer, and biliary cancer. However, the skilled artisan will understand that any cancer that is associated with an oncogenic Kras mutation is encompassed by the present invention.

VII. Design of Polypeptide Inhibitors

Methods for designing inhibitors of the polypeptides of the invention (e.g., RPIA, RPE, Gfpt1, etc.) are well known in the art. The following are thus provided as non-limiting examples of such inhibitors; the skilled artisan will understand that other inhibitors that decrease the level of expression or activity of a target polypeptide of the invention are also encompassed by the present invention.

i. Antisense Nucleic Acids

Antisense oligonucleotides can be used to inhibit the expression of a target polypeptide of the invention (e.g., Gfpt1, RPIA, RPE, etc.). Antisense oligonucleotides typically comprise from about 5 nucleotides to about 30 nucleotides in length, preferably from about 10 to about 25 nucleotides in length, and more preferably from about 20 to about 25 nucleotides in length. For a general discussion of antisense technology, see, e.g., Antisense DNA and RNA, (Cold Spring Harbor Laboratory, D. Melton, ed., 1988).

Appropriate chemical modifications of the inhibitors are made to ensure stability of the antisense oligonucleotide, as described below. Changes in the nucleotide sequence and/or in the length of the antisense oligonucleotide can be made to ensure maximum efficiency and thermodynamic stability of the inhibitor. Such sequence and/or length modifications are readily determined by one of ordinary skill in the art.

The antisense oligonucleotides can be DNA or RNA or chimeric mixtures, or derivatives or modified versions thereof, and can be single-stranded or double-stranded. Thus, for example, in the antisense oligonucleotides set forth in herein, when a sequence includes thymidine residues, one or more of the thymidine residues may be replaced by uracil residues and, conversely, when a sequence includes uracil residues, one or more of the uracil residues may be replaced by thymidine residues.

Antisense oligonucleotides comprise sequences complementary to at least a portion of the corresponding target polypeptide. However, 100% sequence complementarity is not required so long as formation of a stable duplex (for single stranded antisense oligonucleotides) or triplex (for double stranded antisense oligonucleotides) can be achieved. The ability to hybridize will depend on both the degree of complementarity and the length of the antisense oligonucleotides. Generally, the longer the antisense oligonucleotide, the more base mismatches with the corresponding nucleic acid target can be tolerated. One skilled in the art can ascertain a tolerable degree of mismatch by use of standard procedures to determine the melting point of the hybridized complex.

Antisense nucleic acid molecules can be encoded by a recombinant gene for expression in a cell (see, e.g., U.S. Pat. Nos. 5,814,500 and 5,811,234), or alternatively they can be prepared synthetically (see, e.g., U.S. Pat. No. 5,780,607).

The antisense oligonucleotides can be modified at the base moiety, sugar moiety, or phosphate backbone, or a combination thereof. In one embodiment, the antisense oligonucleotide comprises at least one modified sugar moiety, e.g., a sugar moiety selected from arabinose, 2-fluoroarabinose, xylulose, and hexose.

In another embodiment, the antisense oligonucleotide comprises at least one modified phosphate backbone selected from a phosphorothioate, a phosphorodithioate, a phosphoramidothioate, a phosphoramidate, a phosphordiamidate, a methylphosphonate, an alkyl phosphotriester, and a formacetal or analog thereof. Examples include, without limitation, phosphorothioate antisense oligonucleotides (e.g., an antisense oligonucleotide phosphothioate modified at 3' and 5' ends to increase its stability) and chimeras between methylphosphonate and phosphodiester oligonucleotides. These oligonucleotides provide good in vivo activity due to solubility, nuclease resistance, good cellular uptake, ability to activate RNase H, and high sequence selectivity.

Other examples of synthetic antisense oligonucleotides include oligonucleotides that contain phosphorothioates, phosphotriesters, methyl phosphonates, short chain alkyl, or cycloalkyl intersugar linkages or short chain heteroatomic or heterocyclic intersugar linkages. Most preferred are those with CH2-NH—O—CH2, CH2-N(CH3)-O—CH2, CH2-O—N(CH3)-CH2, CH2-N(CH3)-N(CH3)-CH2 and O—N(CH3)-CH2-CH2 backbones (where phosphodiester is O—PO2-O—CH2). U.S. Pat. No. 5,677,437 describes heteroaromatic oligonucleoside linkages. Nitrogen linkers or groups containing nitrogen can also be used to prepare oligonucleotide mimics (U.S. Pat. Nos. 5,792,844 and 5,783,682). U.S. Pat. No. 5,637,684 describes phosphoramidate and phosphorothioamidate oligomeric compounds.

In other embodiments, such as the peptide-nucleic acid (PNA) backbone, the phosphodiester backbone of the oligonucleotide may be replaced with a polyamide backbone, the bases being bound directly or indirectly to the aza nitrogen atoms of the polyamide backbone (Nielsen et al., Science 1991; 254:1497). Other synthetic oligonucleotides may contain substituted sugar moieties comprising one of the following at the 2' position: OH, SH, SCH3, F, OCN, O(CH2)nNH2 or O(CH2)nCH3 where n is from 1 to about 10; C1 to C10 lower alkyl, substituted lower alkyl, alkaryl or aralkyl; Cl; Br; CN; CF3; OCF3; O-; S-, or N-alkyl; O-, S-, or N-alkenyl; SOCH3; SO2CH3; ONO2; NO2; N3; NH2; heterocycloalkyl; heterocycloalkaryl; aminoalkylamino; polyalkylamino; substituted sialyl; a fluorescein moiety; an RNA cleaving group; a reporter group; an intercalator; a group for improving the pharmacokinetic properties of an oligonucleotide; or a group for improving the pharmacodynamic properties of an oligonucleotide, and other substituents having similar properties.

Oligonucleotides may also have sugar mimetics such as cyclobutyls or other carbocyclics in place of the pentofuranosyl group. Nucleotide units having nucleosides other than adenosine, cytidine, guanosine, thymidine and uridine may be used, such as inosine. In other embodiments, locked nucleic acids (LNA) can be used (reviewed in, e.g., Jepsen and Wengel, Curr. Opin. Drug Discov. Devel. 2004; 7:188-194; Crinelli et al., Curr. Drug Targets 2004; 5:745-752). LNA are nucleic acid analog(s) with a 2'-O, 4'-C methylene bridge. This bridge restricts the flexibility of the ribofuranose ring and locks the structure into a rigid C3-endo conformation, conferring enhanced hybridization performance and exceptional biostability. LNA allows the use of very short oligonucleotides (less than 10 bp) for efficient hybridization in vivo.

In one embodiment, an antisense oligonucleotide can comprise at least one modified base moiety selected from a group including but not limited to 5-fluorouracil, 5-bromouracil, 5-chlorouracil, 5-iodouracil, hypoxanthine, xantine, 4-acetylcytosine, 5-(carboxyhydroxylmethyl)uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5-methoxycarboxymethyluracil, 5-methoxyuracil, 2-methylthio-N6-isopentenyladenine, uracil-5-oxyacetic acid (v), pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl)uracil, (acp3)w, and 2,6-diaminopurine.

In another embodiment, the antisense oligonucleotide can include α-anomeric oligonucleotides. An α-anomeric oligonucleotide forms specific double-stranded hybrids with complementary RNA in which, contrary to the usual β-units, the strands run parallel to each other (Gautier et al., Nucl. Acids Res. 1987; 15:6625-6641).

Oligonucleotides may have morpholino backbone structures (U.S. Pat. No. 5,034,506). Thus, in yet another embodiment, the antisense oligonucleotide can be a morpholino antisense oligonucleotide (i.e., an oligonucleotide in which the bases are linked to 6-membered morpholine rings, which are connected to other morpholine-linked bases via non-ionic phosphorodiamidate intersubunit linkages). Morpholino oligonucleotides are highly resistant to nucleases and have good targeting predictability, high in-cell efficacy and high sequence specificity (U.S. Pat. No. 5,034,506; Summerton, Biochim. Biophys. Acta 1999; 1489:141-158; Summerton and Weller, Antisense Nucleic Acid Drug Dev. 1997; 7:187-195; Arora et al., J. Pharmacol. Exp. Ther. 2000; 292:921-928; Qin et al., Antisense Nucleic Acid Drug Dev. 2000; 10:11-16; Heasman et al., Dev. Biol. 2000; 222:124-134; Nasevicius and Ekker, Nat. Genet. 2000; 26:216-220).

Antisense oligonucleotides may be chemically synthesized, for example using appropriately protected ribonucleoside phosphoramidites and a conventional DNA/RNA synthesizer. Antisense nucleic acid oligonucleotides can also be produced intracellularly by transcription from an exogenous sequence. For example, a vector can be introduced in vivo such that it is taken up by a cell within which the vector or a portion thereof is transcribed to produce an antisense RNA. Such a vector can remain episomal or become chromosomally integrated, so long as it can be transcribed to produce the desired antisense RNA. Such vectors can be constructed by recombinant DNA technology methods standard in the art. Vectors can be plasmid, viral, or others known in the art, used for replication and expression in mammalian cells. In another embodiment, "naked" antisense nucleic acids can be delivered to adherent cells via "scrape delivery", whereby the antisense oligonucleotide is added to a culture of adherent cells in a culture vessel, the cells are scraped from the walls of the culture vessel, and the scraped cells are transferred to another plate where they are allowed to re-adhere. Scraping the cells from the culture vessel walls serves to pull adhesion plaques from the cell membrane, generating small holes that allow the antisense oligonucleotides to enter the cytosol.

ii. RNAi

Reversible short inhibition of a target polypeptide (e.g., Gfpt1, RPIA, RPE, etc.) of the invention may also be useful. Such inhibition can be achieved by use of siRNAs. RNA interference (RNAi) technology prevents the expression of genes by using small RNA molecules such as small interfering RNAs (siRNAs). This technology in turn takes advantage of the fact that RNAi is a natural biological mechanism for silencing genes in most cells of many living organisms, from plants to insects to mammals (McManus et al., Nature Reviews Genetics, 2002, 3(10) p. 737). RNAi prevents a gene from producing a functional protein by ensuring that the molecule intermediate, the messenger RNA copy of the gene is destroyed siRNAs can be used in a naked form and incorporated in a vector, as described below.

RNA interference (RNAi) is a process of sequence-specific post-transcriptional gene silencing by which double stranded RNA (dsRNA) homologous to a target locus can specifically inactivate gene function in plants, fungi, invertebrates, and vertebrates, including mammals (Hammond et al., Nature Genet. 2001; 2:110-119; Sharp, Genes Dev. 1999; 13:139-141). This dsRNA-induced gene silencing is mediated by short double-stranded small interfering RNAs (siRNAs) generated from longer dsRNAs by ribonuclease III cleavage (Bernstein et al., Nature 2001; 409:363-366 and Elbashir et al., Genes Dev. 2001; 15:188-200). RNAi-mediated gene silencing is thought to occur via sequence-specific RNA degradation, where sequence specificity is determined by the interaction of an siRNA with its complementary sequence within a target RNA (see, e.g., Tuschl, Chem. Biochem. 2001; 2:239-245).

For mammalian systems, RNAi commonly involves the use of dsRNAs that are greater than 500 bp; however, it can also be activated by introduction of either siRNAs (Elbashir, et al., Nature 2001; 411: 494-498) or short hairpin RNAs (shRNAs) bearing a fold back stem-loop structure (Paddison et al., Genes Dev. 2002; 16: 948-958; Sui et al., Proc. Natl. Acad. Sci. USA 2002; 99:5515-5520; Brummelkamp et al., Science 2002; 296:550-553; Paul et al., Nature Biotechnol. 2002; 20:505-508).

The siRNAs are preferably short double stranded nucleic acid duplexes comprising annealed complementary single stranded nucleic acid molecules. Preferably, the siRNAs are short dsRNAs comprising annealed complementary single strand RNAs. siRNAs may also comprise an annealed RNA:DNA duplex, wherein the sense strand of the duplex is a DNA molecule and the antisense strand of the duplex is a RNA molecule.

Preferably, each single stranded nucleic acid molecule of the siRNA duplex is of from about 19 nucleotides to about 27 nucleotides in length. In preferred embodiments, duplexed siRNAs have a 2 or 3 nucleotide 3' overhang on each strand of the duplex. In preferred embodiments, siRNAs have 5'-phosphate and 3'-hydroxyl groups.

RNAi molecules may include one or more modifications, either to the phosphate-sugar backbone or to the nucleoside. For example, the phosphodiester linkages of natural RNA may be modified to include at least one heteroatom other than oxygen, such as nitrogen or sulfur. In this case, for example, the phosphodiester linkage may be replaced by a phosphothioester linkage. Similarly, bases may be modified to block the activity of adenosine deaminase. Where the RNAi molecule is produced synthetically, or by in vitro transcription, a modified ribonucleoside may be introduced during synthesis or transcription. The skilled artisan will understand that many of the modifications described above for antisense oligonucleotides may also be made to RNAi molecules. Such modifications are well known in the art.

siRNAs may be introduced to a target cell as an annealed duplex siRNA, or as single stranded sense and antisense nucleic acid sequences that, once within the target cell, anneal to form the siRNA duplex. Alternatively, the sense and antisense strands of the siRNA may be encoded on an expression construct that is introduced to the target cell. Upon expression within the target cell, the transcribed sense and antisense strands may anneal to reconstitute the siRNA.

shRNAs typically comprise a single stranded "loop" region connecting complementary inverted repeat sequences that anneal to form a double stranded "stem" region. Structural considerations for shRNA design are discussed, for example, in McManus et al., RNA 2002; 8:842-850. In certain embodiments the shRNA may be a portion of a larger RNA molecule, e.g., as part of a larger RNA that also contains U6 RNA sequences (Paul et al., supra).

In preferred embodiments, the loop of the shRNA is from about 1 to about 9 nucleotides in length. In preferred embodiments the double stranded stem of the shRNA is from about 19 to about 33 base pairs in length. In preferred embodiments, the 3' end of the shRNA stem has a 3' overhang. In particularly preferred embodiments, the 3' overhang of the shRNA stem is from 1 to about 4 nucleotides in length. In preferred embodiments, shRNAs have 5'-phosphate and 3'-hydroxyl groups.

Although RNAi molecules preferably contain nucleotide sequences that are fully complementary to a portion of the target nucleic acid, 100% sequence complementarity between the RNAi probe and the target nucleic acid is not required.

Similar to the above-described antisense oligonucleotides, RNAi molecules can be synthesized by standard methods known in the art, e.g., by use of an automated synthesizer. RNAs produced by such methodologies tend to be highly pure and to anneal efficiently to form siRNA duplexes or shRNA hairpin stem-loop structures. Following chemical synthesis, single stranded RNA molecules are deprotected, annealed to form siRNAs or shRNAs, and purified (e.g., by gel electrophoresis or HPLC). Alternatively, standard procedures may be used for in vitro transcription of RNA from DNA templates carrying RNA polymerase promoter sequences (e.g., T7 or SP6 RNA polymerase promoter sequences). Efficient in vitro protocols for preparation of siRNAs using T7 RNA polymerase have been described (Done and Picard, Nucleic Acids Res. 2002; 30:e46; and Yu et al., Proc. Natl. Acad. Sci. USA 2002; 99:6047-6052). Similarly, an efficient in vitro protocol for preparation of shRNAs using T7 RNA polymerase has been described (Yu et al., supra). The sense and antisense transcripts may be synthesized in two independent reactions and annealed later, or may be synthesized simultaneously in a single reaction.

RNAi molecules may be formed within a cell by transcription of RNA from an expression construct introduced into the cell. For example, both a protocol and an expression construct for in vivo expression of siRNAs are described in Yu et al., supra. The delivery of siRNA to tumors can potentially be achieved via any of several gene delivery "vehicles" that are currently available. These include viral vectors, such as adenovirus, lentivirus, herpes simplex virus, vaccinia virus, and retrovirus, as well as chemical-mediated gene delivery systems (for example, liposomes), or mechanical DNA delivery systems (DNA guns). The oligonucleotides to be expressed for such siRNA-mediated inhibition of gene expression would be between 18 and 28 nucleotides in length. Protocols and expression constructs for in vivo expression of shRNAs have been described (Brummelkamp et al., Science 2002; 296:550-553; Sui et al., supra; Yu et al., supra; McManus et al., supra; Paul et al., supra).

The expression constructs for in vivo production of RNAi molecules comprise RNAi encoding sequences operably linked to elements necessary for the proper transcription of the RNAi encoding sequence(s), including promoter elements and transcription termination signals. Preferred promoters for use in such expression constructs include the polymerase-III HI-RNA promoter (see, e.g., Brummelkamp et al., supra) and the U6 polymerase-III promoter (see, e.g., Sui et al., supra; Paul, et al. supra; and Yu et al., supra). The RNAi expression constructs can further comprise vector sequences that facilitate the cloning of the expression constructs. Standard vectors are known in the art (e.g., pSilencer 2.0-U6 vector, Ambion Inc., Austin, Tex.).

iii. Ribozyme Inhibition

The level of expression of a target polypeptide of the invention can also be inhibited by ribozymes designed based on the nucleotide sequence thereof.

Ribozymes are enzymatic RNA molecules capable of catalyzing the sequence-specific cleavage of RNA (for a review, see Rossi, Current Biology 1994; 4:469-471). The mechanism of ribozyme action involves sequence-specific hybridization of the ribozyme molecule to complementary target RNA, followed by an endonucleolytic cleavage event. The composition of ribozyme molecules must include: (i) one or more sequences complementary to the target RNA; and (ii) a catalytic sequence responsible for RNA cleavage (see, e.g., U.S. Pat. No. 5,093,246).

The use of hammerhead ribozymes is preferred. Hammerhead ribozymes cleave RNAs at locations dictated by flanking regions that form complementary base pairs with the target RNA. The sole requirement is that the target RNA has the following sequence of two bases: 5'-UG-3'. The construction of hammerhead ribozymes is known in the art, and described more fully in Myers, Molecular Biology and Biotechnology: A Comprehensive Desk Reference, VCH Publishers, New York, 1995 (see especially FIG. 4, page 833) and in Haseloff and Gerlach, Nature 1988; 334:585-591.

As in the case of antisense oligonucleotides, ribozymes can be composed of modified oligonucleotides (e.g., for improved stability, targeting, etc.). These can be delivered to cells which express the target polypeptide in vivo. A preferred method of delivery involves using a DNA construct "encoding" the ribozyme under the control of a strong constitutive pol III or pol II promoter, so that transfected cells will produce sufficient quantities of the ribozyme to catalyze cleavage of the target mRNA encoding the target polypeptide. However, because ribozymes, unlike antisense molecules, are catalytic, a lower intracellular concentration may be required to achieve an adequate level of efficacy.

Ribozymes can be prepared by any method known in the art for the synthesis of DNA and RNA molecules, as discussed above. Ribozyme technology is described further in Intracellular Ribozyme Applications: Principals and Protocols, Rossi and Couture eds., Horizon Scientific Press, 1999.

iv. Triple Helix Forming Oligonucleotides (TFOs)

Nucleic acid molecules useful to inhibit expression level of a target polypeptide of the invention via triple helix formation are preferably composed of deoxynucleotides. The base composition of these oligonucleotides is typically designed to promote triple helix formation via Hoogsteen base pairing rules, which generally require sizeable stretches of either purines or pyrimidines to be present on one strand of a duplex. Nucleotide sequences may be pyrimidine-based, resulting in TAT and CGC triplets across the three associated strands of the resulting triple helix. The pyrimidine-rich molecules provide base complementarity to a purine-rich region of a single strand of the duplex in a parallel orientation to that strand. In addition, nucleic acid molecules may be chosen that are purine-rich, e.g., those containing a stretch of G residues. These molecules will form a triple helix with a DNA duplex that is rich in GC pairs, in which the majority of the purine residues are located on a single strand of the targeted duplex, resulting in GGC triplets across the three strands in the triplex.

Alternatively, sequences can be targeted for triple helix formation by creating a so-called "switchback" nucleic acid molecule. Switchback molecules are synthesized in an alternating 5'-3', 3'-5' manner, such that they base pair with first one strand of a duplex and then the other, eliminating the necessity for a sizeable stretch of either purines or pyrimidines to be present on one strand of a duplex.

Similarly to RNAi molecules, antisense oligonucleotides, and ribozymes, described above, triple helix molecules can be prepared by any method known in the art. These include techniques for chemically synthesizing oligodeoxyribo-nucleotides and oligoribonucleotides such as, e.g., solid phase phosphoramidite chemical synthesis. Alternatively, RNA molecules can be generated by in vitro or in vivo transcription of DNA sequences "encoding" the particular RNA molecule. Such DNA sequences can be incorporated into a wide variety of vectors that incorporate suitable RNA polymerase promoters such as the T7 or SP6 polymerase promoters. See, Nielsen, P. E. "Triple Helix: Designing a New Molecule of Life", Scientific American, December, 2008; Egholm, M., et al. "PNA Hybridizes to Complementary Oligonucleotides Obeying the Watson-Crick Hydrogen Bonding Rules." (1993) Nature, 365, 566-568; Nielsen, P. E. 'PNA Technology'. Mol Biotechnol. 2004; 26:233-48.

VIII. Methods of Determining Efficacy of a Cancer Therapy

In certain embodiments, the present invention provides a method for determining the efficacy of a cancer therapy in a subject, wherein the cancer is associated with an oncogenic Kras mutation. In a preferred embodiment, the method comprises assaying a sample from a subject who is undergoing or has recently undergone a cancer therapy for: (1) a change in the level of expression or activity of one or more polypeptides mediating a function linked to a metabolic pathway that uses glucose or a glucose derivative as a substrate compared to a reference sample, wherein an increased or maintained level of expression or activity of said one or more polypeptides indicates poor efficacy and a decreased level or expression of said one or more polypeptides indicates efficacy, wherein said level of expression or activity is regulated by oncogenic Kras; or (2) a change in the level of one or more metabolites associated with a function linked to a metabolic pathway that uses glucose or a glucose derivative as a substrate compared to a reference sample, wherein an increased or maintained level of said one more metabolites indicates poor efficacy and a decreased level of said one or more metabolites indicates efficacy, and wherein said level of said one or more metabolites is regulated by oncogenic Kras. The present methods provide the advantageous benefit of allowing earlier determination during a treatment regimen of whether a cancer therapy is working, compared, e.g. to waiting to see if a tumor regresses.

It is to be understood that, in certain embodiments, changes in the level of expression and/or activity of multiple (2 or more) polypeptides and/or the level of multiple (2 or more) metabolites disclosed above may be determined in order to determine the efficacy of a cancer therapy. Any combination of polypeptides and/or metabolites may be assayed according to the present methods. Of course, in certain embodiments, the level of expression or activity of a single polypeptide or the level of a single metabolite may also be assayed.

Cancer therapies include, for example, chemotherapy, radiation therapy, anti-angiogenic therapy, surgery, and combinations thereof Chemotherapeutic agents, include for example: taxanes such as taxol, taxotere or their analogues; alkylating agents such as cyclophosphamide, isosfamide, melphalan, hexamethylmelamine, thiotepa or dacarbazine; antimetabolites such as pyrimidine analogues, for instance 5-fluorouracil, cytarabine, capecitabine, and gemcitabine or its analogues such as 2-fluorodeoxycytidine; folic acid analogues such as methotrexate, idatrexate or trimetrexate; spindle poisons including vinca alkaloids such as vinblastine, vincristine, vinorelbine and vindesine, or their synthetic analogues such as navelbine, or estramustine and a taxoid; platinum compounds such as cisplatin; epipodophyllotoxins such as etoposide or teniposide; antibiotics such as daunorubicin, doxorubicin, bleomycin or mitomycin, enzymes such as L-asparaginase, topoisomerase inhibitors such as topotecan or pyridobenzoindole derivatives; and various agents such as procarbazine, mitoxantrone, and biological response modifiers or growth factor inhibitors such as interferons or interleukins. Other chemotherapeutic agents include, though are not limited to, a p38/JAK kinase inhibitor, e.g., SB203580; a phospatidyl inositol-3 kinase (PI3K) inhibitor, e.g., LY294002; a MAPK inhibitor, e.g. PD98059; a JAK inhibitor, e.g., AG490; preferred chemotherapeutics such as UCN-01, NCS, mitomycin C (MMC), NCS, and anisomycin; taxoids in addition to those describe above (e.g., as disclosed in U.S. Pat. Nos. 4,857,653; 4,814,470; 4,924,011, 5,290,957; 5,292,921; 5,438,072; 5,587,493; European Patent No. 0 253 738; and PCT Publication Nos. WO 91/17976, WO 93/00928, WO 93/00929, and WO 96/01815. In other embodiments, a cancer therapy can include but is not limited to administration of interferon (IFN)-gamma, tumor necrosis factor (TNF)-alpha, TNF-beta, and/or similar cytokines, or an antagonist of a tumor growth factor (e.g., TGF-β and IL-10). Antiangiogenic agents, include, e.g., endostatin, angiostatin, TNP-470, Caplostatin (Stachi-Fainaro et al., Cancer Cell 7(3), 251 (2005)). Drugs that interfere with intracellular protein synthesis can also be used in the methods of the present invention; such drugs are known to those skilled in the art and include puromycin, cycloheximide, and ribonuclease.

For radiation therapy, common sources of radiation used for cancer treatment include, but are not limited to, high-energy photons that come from radioactive sources such as cobalt, cesium, iodine, palladium, or a linear accelerator, proton beams; neutron beams (often used for cancers of the head, neck, and prostate and for inoperable tumors).

It is well known that radioisotopes, drugs, and toxins can be conjugated to antibodies or antibody fragments which specifically bind to markers which are produced by or associated with cancer cells, and that such antibody conjugates can be used to target the radioisotopes, drugs or toxins to tumor sites to enhance their therapeutic efficacy and minimize side effects. Examples of these agents and methods are reviewed in Wawrzynczak and Thorpe (in Introduction to the Cellular and Molecular Biology of Cancer, L. M. Franks and N. M. Teich, eds, Chapter 18, pp. 378-410, Oxford University Press. Oxford, 1986), in Immunoconjugates: Antibody Conjugates in Radioimaging and Therapy of Cancer (C. W. Vogel, ed., 3-300, Oxford University Press, N.Y., 1987), in Dillman, R. O. (CRC Critical Reviews in Oncology/Hematology 1:357, CRC Press, Inc., 1984), in Pastan et al. (Cell 47:641, 1986) in Vitetta et al. (Science 238:1098-1104, 1987) and in Brady et al. (Int. J. Rad. Oncol. Biol. Phys. 13:1535-1544, 1987). Other examples of the use of immunoconjugates for cancer and other forms of therapy have been disclosed, inter alia, in U.S. Pat. Nos. 4,331,647, 4,348,376, 4,361,544, 4,468,457, 4,444,744, 4,460,459, 4,460,561 4,624,846, 4,818,709, 4,046,722, 4,671,958, 4,046,784, 5,332,567, 5,443,953, 5,541,297, 5,601,825, 5,637,288, 5,677,427, 5,686,578, 5,698,178, 5,789,554, 5,922,302, 6,187,287, and 6,319,500.

In a preferred embodiment, a cancer therapy is targeted to one or more Kras cellular signaling transduction pathways. For example, the cancer therapy may comprise administering to a subject one or more inhibitors of a polypeptide selected from the group consisting of phosphatidylinositol (PI) 3-kinase (PI3K), Akt (e.g., AKT1, AKT2, AKT3), RAF proto-oncogene serine/threonine-protein kinase (e.g. ARAF, BRAF, RAF1), mitogen-activated or extracellular signal-regulated protein kinase kinases (e.g., MEK1, MEK2), and extracellular signal-regulated kinases (e.g., ERK1, ERK2). Exemplary GenBank® Accession Numbers and the corresponding SEQ ID NO (SIN) for the human nucleic acid and amino acid sequences of each of the above-listed polypeptides are shown in Table 2, below. In some instances, when multiple transcript variants are known, only one exemplary variant sequence is set forth in the table, although it is to be understood that other transcript variants are also intended be encompassed by the present invention. In certain instances, multiple transcript variants are exampled for a polypeptide; however when other transcript variants are also known, but not exemplified below, they are encompassed by the present invention. In other words, the exemplary GenBank® Accession numbers (and corresponding sequences) set forth in Table 2 are not limiting. Further, abbreviations for genes and/or polypeptides given in Table 2 are not necessarily exhaustive, and the genes and/or polypeptides may also be known in the art by other names.

TABLE 2

Exemplary GenBank ® Accession Numbers for Kras Signaling Molecules

| SIN | Gene Name | Nucleic Acid GenBank ® Accession No. | SIN | Corresponding Polypeptide Name | Amino Acid GenBank ® Accession No. |
|---|---|---|---|---|---|
| 117 | phosphoinositide-3-kinase, catalytic, alpha polypeptide (PIK3CA) (PI3K) | NM_006218.2 | 118 | phosphatidyl-inositol-4,5-bisphosphate 3-kinase catalytic subunit alpha isoform | NP_006209 |
| 119 | v-akt murine thymoma viral oncogene homolog 1 (AKT1), transcript variant 1 | NM_005163.2 | 120 | RAC-alpha serine/threonine-protein kinase | NP_005154.2 |

TABLE 2-continued

Exemplary GenBank ® Accession Numbers for Kras Signaling Molecules

| SIN | Gene Name | Nucleic Acid GenBank ® Accession No. | SIN | Corresponding Polypeptide Name | Amino Acid GenBank ® Accession No. |
|---|---|---|---|---|---|
| 121 | v-akt murine thymoma viral oncogene homolog 1 (AKT1), transcript variant 2 | NM_001014432.1 | 122 | RAC-alpha serine/threonine-protein kinase | NP_001014432.1 |
| 123 | v-akt murine thymoma viral oncogene homolog 1 (AKT1), transcript variant 3 | NM_001014431.1 | 124 | RAC-alpha serine/threonine-protein kinase | NP_001014431.1 |
| 125 | v-akt murine thymoma viral oncogene homolog 2 (AKT2), transcript variant 1 | NM_001626.4 | 126 | RAC-beta serine/threonine-protein kinase isoform 1 | NP_001617.1 |
| 127 | v-akt murine thymoma viral oncogene homolog 2 (AKT2), transcript variant 2 | NM_001243027.1 | 128 | RAC-beta serine/threonine-protein kinase isoform 2 | NP_001229956.1 |
| 129 | v-akt murine thymoma viral oncogene homolog 2 (AKT2), transcript variant 3 | NM_001243028.1 | 130 | RAC-beta serine/threonine-protein kinase isoform 2 | NP_001229957.1 |
| 131 | v-akt murine thymoma viral oncogene homolog 3 (protein kinase B, gamma) (AKT3), transcript variant 1 | NM_005465.4 | 132 | RAC-gamma serine/threonine-protein kinase isoform 1 | NP_005456.1 |
| 133 | v-akt murine thymoma viral oncogene homolog 3 (protein kinase B, gamma) (AKT3), transcript variant 2 | NM_181690.2 | 134 | RAC-gamma serine/threonine-protein kinase isoform 2 | NP_859029.1 |
| 135 | v-akt murine thymoma viral oncogene homolog 3 (protein kinase B, gamma) (AKT3), transcript variant 3 | NM_001206729.1 | 136 | RAC-gamma serine/threonine-protein kinase isoform 2 | NP_001193658.1 |
| 137 | *Homo sapiens* v-raf-1 murine leukemia viral oncogene homolog 1 (RAF1)(c-RAF) | NM_002880.3 | 138 | RAF proto-oncogene serine/threonine-protein kinase | NP_002871.1 |

TABLE 2-continued

Exemplary GenBank® Accession Numbers for Kras Signaling Molecules

| SIN | Gene Name | Nucleic Acid GenBank® Accession No. | SIN | Corresponding Polypeptide Name | Amino Acid GenBank® Accession No. |
|---|---|---|---|---|---|
| 159 | v-raf murine sarcoma 3611 viral oncogene homolog (ARAF) transcript variant 1 | NM_001654.4 | 160 | serine/threonine-protein kinase A-Raf isoform 1 | NP_001645.1 |
| 161 | v-raf murine sarcoma 3611 viral oncogene homolog (ARAF) transcript variant 2 | NM_001256196.1 | 162 | serine/threonine-protein kinase A-Raf isoform 2 | NP_001243125.1 |
| 163 | v-raf murine sarcoma 3611 viral oncogene homolog (ARAF) transcript variant 3 | NM_001256197.1 | 164 | serine/threonine-protein kinase A-Raf isoform 3 | NP_001243126.1 |
| 139 | v-raf murine sarcoma viral oncogene homolog B1 (BRAF) | NM_004333.4 | 140 | serine/threonine-protein kinase B-raf | NP_004324.2 |
| 141 | *Homo sapiens* mitogen-activated protein kinase kinase 1 (MAP2K1) (MEK1) | NM_002755.3 | 142 | dual specificity mitogen-activated protein kinase kinase 1 | NP_002746.1 |
| 143 | *Homo sapiens* mitogen-activated protein kinase kinase 2 (MAP2K2) (MEK2) | NM_030662 | 144 | dual specificity mitogen-activated protein kinase kinase 2 | NP_109587.1 |
| 145 | mitogen-activated protein kinase 3 (MAPK3) (ERK1), transcript variant 1 | NM_002746.2 | 146 | mitogen-activated protein kinase 3 isoform 1 | NP_002737.2 |
| 147 | *Homo sapiens* mitogen-activated protein kinase 3 (MAPK3) (ERK1), transcript variant 2 | NM_001040056.1 | 148 | mitogen-activated protein kinase 3 isoform 2 | NP_001035145.1 |
| 149 | mitogen-activated protein kinase 3 (MAPK3) (ERK1), transcript variant 3 | NM_001109891.1 | 150 | mitogen-activated protein kinase 3 isoform 3 | NP_001103361.1 |
| 151 | mitogen-activated protein kinase 1 (MAPK1) (ERK2), transcript variant 1 | NM_002745.4 | 152 | mitogen-activated protein kinase 1 | NP_002736.3 |

TABLE 2-continued

Exemplary GenBank® Accession Numbers for Kras Signaling Molecules

| SIN | Gene Name | Nucleic Acid GenBank® Accession No. | SIN | Corresponding Polypeptide Name | Amino Acid GenBank® Accession No. |
|---|---|---|---|---|---|
| 153 | mitogen-activated protein kinase 1 (MAPK1) (ERK2), transcript variant 2 | NM_138957.2 | 154 | mitogen-activated protein kinase 1 | NP_620407.1 |

Such inhibitors include antisense oligonucleotides (e.g., RNA interfering molecules such as siRNA and shRNA), aptamers, ribozymes, and small molecules, including certain chemotherapeutic agents. Non-limiting examples of such inhibitors include AZD8330, which is a MEK inhibitor, BKM120, which is a PI3K inhibitor, and GSK1120212, which is also a MEK inhibitor. The skilled artisan will appreciate that any suitable inhibitor of one or more of the above polypeptides is encompassed by the present invention.

In another embodiment, the cancer therapy comprises administration of an inhibitor of a polypeptide or metabolite (mediating or associated with a function linked to a metabolic pathway that uses glucose or a glucose derivative as substrate) of the invention to a subject in need of such treatment, as described in detail above.

For a cancer therapy to be determined to have efficacy according to the present methods, preferably the level of expression or activity of a polypeptide mediating a function linked to a metabolic pathway that uses glucose or a glucose derivative as a substrate is decreased by a fold-change of at least 2, at least 2.5, at least 3, at least 3.5, at least 4, at least 4.5 fold, at least 5, at least 5.5, at least 6, at least 6.5, at least 7, at least 7.5, at least 8, at least 8.5, at least 9, at least 9.5, at least 10, at least 15, at least 20, or more, compared to the reference sample. In a preferred embodiment, the level of expression or activity is decreased by at least 2-fold.

Similarly, for a cancer therapy to be determined to have efficacy according to the present methods, preferably the level of one or more metabolites associated with a function linked to a metabolic pathway that uses glucose or a glucose derivative as a substrate is decreased by a fold-change of at least 2, at least 2.5, at least 3, at least 3.5, at least 4, at least 4.5 fold, at least 5, at least 5.5, at least 6, at least 6.5, at least 7, at least 7.5, at least 8, at least 8.5, at least 9, at least 9.5, at least 10, at least 15, at least 20, or more, compared to the control sample. In a preferred embodiment, the level is decreased by at least 2-fold.

As discussed above, a reference sample is preferably obtained from a subject prior to or at the beginning of a cancer therapy, for comparison to the sample obtained from the subject during and/or subsequent to therapy, e.g., in order to determine the efficacy of the therapy. However, in another embodiment, the reference sample may be a "standardized control sample," which can be a sample or combination of samples obtained from one or more individuals whom have been determined to not comprise an oncogenic Kras. Such a negative control sample may be useful, e.g., if a subject's "prior to or at the beginning of cancer therapy" sample is not available or was not obtained.

IX. Administration

Compositions and formulations comprising an inhibitor of the invention (e.g., an inhibitor of a polypeptide (e.g., RPIA, RPE, GFPT-1, GLUT1/SLC2A1, etc.) or a metabolite (e.g., PEP, lactate) of the invention, can be administered topically, parenterally, orally, by inhalation, as a suppository, or by other methods known in the art. The term "parenteral" includes injection (for example, intravenous, intraperitoneal, epidural, intrathecal, intramuscular, intraluminal, intratracheal or subcutaneous).

While it is possible to use an inhibitor of the invention for therapy as is, it may be preferable to administer an inhibitor as a pharmaceutical formulation, e.g., in admixture with a suitable pharmaceutical excipient, diluent, or carrier selected with regard to the intended route of administration and standard pharmaceutical practice. Pharmaceutical formulations comprise at least one active compound, or a pharmaceutically acceptable derivative thereof, in association with a pharmaceutically acceptable excipient, diluent, and/or carrier. The excipient, diluent and/or carrier must be "acceptable," as defined above.

Administration of an inhibitor of the invention can be once a day, twice a day, or more often. Frequency may be decreased during a treatment maintenance phase of the disease or disorder, e.g., once every second or third day instead of every day or twice a day. The dose and the administration frequency will depend on the clinical signs, which confirm maintenance of the remission phase, with the reduction or absence of at least one or more preferably more than one clinical signs of the acute phase known to the person skilled in the art. More generally, dose and frequency will depend in part on recession of pathological signs and clinical and subclinical symptoms of a disease condition or disorder contemplated for treatment with the present compounds.

It will be appreciated that the amount of an inhibitor required for use in treatment will vary with the route of administration, the nature of the condition for which treatment is required, and the age, body weight and condition of the patient, and will be ultimately at the discretion of the attendant physician or veterinarian. Compositions will typically contain an effective amount of the active agent(s), alone or in combination. Preliminary doses can be determined according to animal tests, and the scaling of dosages for human administration can be performed according to art-accepted practices.

Length of treatment, i.e., number of days, will be readily determined by a physician treating the subject, however the number of days of treatment may range from 1 day to about 20 days. As provided by the present methods, the efficacy of treatment can be monitored during the course of treatment to determine whether the treatment has been successful, or whether additional (or modified) treatment is necessary.

X. Kits

In certain embodiments, the invention provides kits for use in detecting the expression or activity of one or more polypeptides mediating a function linked to a metabolic pathway that uses glucose or a glucose derivative as a substrate, compared to a control sample, and/or an elevated level of one or more metabolites associated with a function linked to a metabolic pathway that uses glucose or a glucose derivative as a substrate, compared to a control sample.

In one embodiment, a kit may include a solid support with affixed oligonucleotides specific to any number of the polypeptides selected from the group consisting of HK1, HK2, PFK1, ENO1 and LDHA, RPIA and RPE, glutamine-fructose-6-phosphate transaminase 1 (GFPT1), B4GALT4, B4GALT5, C1GALT1C1, GALNT12, GALNT3, GCNT3, GCS1, HS3ST1, MGAT4A, MGAT5, ST3GAL1, NME6, CTPS, ENTPD8, POLE3, POLE, NUDT2, DTYMK, RFC5, POLR2C, POLR2D, ENTPD3, PRIM1, POLR2H, ECGF1, POLR3G, POLD4, DCTD, CAD, POLD2, TK1, UPP1, RRM2, SC5DL, SC4MOL, MVK, HMGCR, LSS, HMGCS1, MVD, DHCR7, PMVK, CYP51A1, FDFT1, FDPS, SQLE, IDI1, FASN, and GLUT1/SLC2A1. Other oligonucleotides specific to other polypeptides, such as controls or other targets, may also be included on the solid support. In a specific embodiment, the kit may also comprise oligonucleotides specific for one or more oncogenic Kras genes, e.g., one or more Kras comprising a mutation selected from $Kras^{G12D}$, $Kras^{G12V}$, $Kras^{G13D}$, $Kras^{G12C}$, $Kras^{Q61R}$, $Kras^{Q61L}$, $Kras^{Q61K}$, $Kras^{G12R}$, or $Kras^{G12C}$. A test biological sample may be applied to the solid support, under selective hybridization conditions, for the determination of the expression of the polypeptides (such as, e.g., the determination of a specific hybridization pattern of the polypeptides).

The above-described kits comprising oligonucleotides affixed to a solid support may additionally comprise instructions for interpreting the results obtained from using the kit to detect expression of the above-listed polypeptides. For example, if one or more of the polypeptides selected from the group consisting of HK1, HK2, PFK1, ENO1 and LDHA, RPIA and RPE, glutamine-fructose-6-phosphate transaminase 1 (GFPT1), B4GALT4, B4GALT5, C1GALT1C1, GALNT12, GALNT3, GCNT3, GCS1, HS3ST1, MGAT4A, MGAT5, ST3GAL1, NME6, CTPS, ENTPD8, POLE3, POLE, NUDT2, DTYMK, RFC5, POLR2C, POLR2D, ENTPD3, PRIM1, POLR2H, ECGF1, POLR3G, POLD4, DCTD, CAD, POLD2, TK1, UPP1, RRM2, SC5DL, SC4MOL, MVK, HMGCR, LSS, HMGCS1, MVD, DHCR7, PMVK, CYP51A1, FDFT1, FDPS, SQLE, IDI1, FASN, and GLUT1/SLC2A1, is determined to have increased expression in a sample, e.g., from a patient suspected of having cancer, relative to a control sample, the instructions may indicate that a diagnosis of cancer should be made. In a particular embodiment, if the sample tests positive for an oncogenic Kras gene and for increased expression of one or more of the above polypeptides, the instructions may indicate that diagnosis of cancer may be made. However, in another embodiment, when one or more of the above polypeptides is determined to have decreased expression in the sample, the instructions may indicate that a diagnosis of cancer should be made.

In another embodiment, the instructions may comprise a hybridization pattern for comparison to the hybridization pattern of the sample tested using the kit. For example, the hybridization pattern may be the typical hybridization pattern (i.e., gene expression profile) of two or more of the above-listed polypeptides (i.e., the cDNA encoding those polypeptides) in samples from subjects that either do comprise an oncogenic Kras gene or that do not comprise an oncogenic Kras gene. In one embodiment, the instructions may provide at least two hybridization patterns for comparison, wherein one hybridization pattern may be the typical hybridization pattern (i.e. gene expression profile) of two or more of the above-listed polypeptides (i.e., the cDNA encoding those polypeptides) in samples from subjects that do comprise an oncogenic Kras gene and the other is the typical hybridization pattern of two or more of the above-listed polypeptides in samples from subjects that do not comprise an oncogenic Kras gene. Typically, the instructions will describe how to compare the test results (i.e., hybridization pattern) to the hybridization patterns provided in the instructions.

In another embodiment, a kit comprising an antibody capable of immunospecifically binding a polypeptide selected from the group consisting of HK1, HK2, PFK1, ENO1 and LDHA, RPIA and RPE, glutamine-fructose-6-phosphate transaminase 1 (GFPT1), B4GALT4, B4GALT5, C1GALT1C1, GALNT12, GALNT3, GCNT3, GCS1, HS3ST1, MGAT4A, MGAT5, ST3GAL1, NME6, CTPS, ENTPD8, POLE3, POLE, NUDT2, DTYMK, RFC5, POLR2C, POLR2D, ENTPD3, PRIM1, POLR2H, ECGF1, POLR3G, POLD4, DCTD, CAD, POLD2, TK1, UPP1, RRM2, SC5DL, SC4MOL, MVK, HMGCR, LSS, HMGCS1, MVD, DHCR7, PMVK, CYP51A1, FDFT1, FDPS, SQLE, IDI1, FASN, and GLUT1/SLC2A1, and instructions for using the antibody to examine the sample for expression of that polypeptide is provided. In preferred methods, the kit comprises several different antibodies, each of which is capable of immunospecifically binding in a sample a polypeptide selected from the group consisting of HK1, HK2, PFK1, ENO1 and LDHA, RPIA and RPE, glutamine-fructose-6-phosphate transaminase 1 (GFPT1), B4GALT4, B4GALT5, C1GALT1C1, GALNT12, GALNT3, GCNT3, GCS1, HS3ST1, MGAT4A, MGAT5, ST3GAL1, NME6, CTPS, ENTPD8, POLE3, POLE, NUDT2, DTYMK, RFC5, POLR2C, POLR2D, ENTPD3, PRIM1, POLR2H, ECGF1, POLR3G, POLD4, DCTD, CAD, POLD2, TK1, UPP1, RRM2, SC5DL, SC4MOL, MVK, HMGCR, LSS, HMGCS1, MVD, DHCR7, PMVK, CYP51A1, FDFT1, FDPS, SQLE, IDI1, FASN, and GLUT1/SLC2A1.

Antibodies (monoclonal or polyclonal) are commercially available and may also be prepared by methods known to those of skill in the art, for example, in Current Protocols in Immunology, John Wiley & Sons, Edited by: John E. Coligan, Ada M. Kruisbeek, David H. Margulies, Ethan M. Shevach, Warren Strober, 2001.

In certain embodiments, the antigen or the antibody may be bound to a solid support, such as a column matrix or well of a microtitre plate. The immunodetection reagents of the kit may take any one of a variety of forms; including those detectable labels that are associated with, or linked to, the given antibody or antigen itself. Detectable labels that are associated with or attached to a secondary binding ligand are also contemplated. Exemplary secondary ligands are those secondary antibodies that have binding affinity for the first antibody or antigen.

Suitable assay labels are known in the art and include enzyme labels, such as, glucose oxidase; radioisotopes, such as iodine ($^{131}$I, $^{125}$I, $^{123}$I, $^{121}$I), carbon ($^{14}$C), sulfur ($^{35}$S), tritium ($^3$H), indium ($^{115}$mIn, $^{113}$mIn, $^{112}$In, $^{111}$In), and technetium ($^{99}$Tc, $^{99}$mTc), thallium ($^{201}$Ti), gallium ($^{68}$Ga, $^{67}$Ga), palladium ($^{103}$Pd), molybdenum ($^{99}$Mo), xenon ($^{133}$Xe), fluorine (18F), $^{153}$Sm, $^{177}$Lu, $^{159}$Gd, $^{149}$Pm, $^{140}$La, $^{175}$Yb, $^{166}$Ho, $^{90}$Y, $^{47}$Sc, $^{186}$Re, $^{188}$Re, $^{142}$Pr, $^{105}$Rh, $^{97}$Ru; luminescent labels, such as luminol; and fluorescent labels, such as fluorescein and rhodamine, and biotin.

Further suitable immunodetection reagents for use in the present kits include the two-component reagent that comprises a secondary antibody that has binding affinity for the first antibody or antigen, along with a third antibody that has binding affinity for the second antibody, wherein the third antibody is linked to a detectable label.

A number of exemplary labels are known in the art and all such labels may be employed in connection with the present invention. Radiolabels, nuclear magnetic spin-resonance isotopes, fluorescent labels and enzyme tags capable of generating a colored product upon contact with an appropriate substrate are suitable examples.

The kits may contain antibody-label conjugates either in fully conjugated form, in the form of intermediates, or as separate moieties to be conjugated by the user of the kit.

The kits may further comprise a suitably aliquoted composition of an antigen whether labeled or unlabeled, as may be used to prepare a standard curve for a detection assay or as a positive control.

The kits of the invention, regardless of type, will generally comprise one or more containers into which the biological agents are placed and, preferably, suitably aliquoted. The components of the kits may be packaged either in aqueous media or in lyophilized form.

The immunodetection kits of the invention may additionally contain one or more of a variety of other cancer marker antibodies or antigens, if so desired. Such kits could thus provide a panel of cancer markers, as may be better used in testing a variety of patients. By way of example, such additional markers could include, other tumor markers such as PSA, SeLe (X), HCG, as well as p53, cyclin D1, p16, tyrosinase, MAGE, BAGE, PAGE, MUC18, CEA, p27, [bgr]HCG, CA-19-9, or other markers known to those of skill in the art.

The container means of the kits will generally include at least one vial, test tube, flask, bottle, or even syringe or other container means, into which the antibody or antigen may be placed, and preferably, suitably aliquotted. Where a second or third binding ligand or additional component is provided, the kit will also generally contain a second, third or other additional container into which this ligand or component may be placed.

The kits of the present invention will also typically include a means for containing the antibody, antigen, and any other reagent containers in close confinement for commercial sale. Such containers may include injection or blow-molded plastic containers into which the desired vials are retained The above-described kits may come with instructions for interpreting the results obtained from using the kit to detect expression of the above-listed polypeptides. For example, if one or more of the polypeptides selected from the group consisting of HK1, HK2, PFK1, ENO1 and LDHA, RPIA and RPE, glutamine-fructose-6-phosphate transaminase 1 (GFPT1), B4GALT4, B4GALT5, C1GALT1C1, GALNT12, GALNT3, GCNT3, GCS1, HS3ST1, MGAT4A, MGAT5, ST3GAL1, NME6, CTPS, ENTPD8, POLE3, POLE, NUDT2, DTYMK, RFC5, POLR2C, POLR2D, ENTPD3, PRIM1, POLR2H, ECGF1, POLR3G, POLD4, DCTD, CAD, POLD2, TK1, UPP1, RRM2, SC5DL, SC4MOL, MVK, HMGCR, LSS, HMGCS1, MVD, DHCR7, PMVK, CYP51A1, FDFT1, FDPS, SQLE, IDI1, FASN, and GLUT1/SLC2A1, is determined to have increased expression in a sample, e.g., from a patient suspected of having cancer, relative to a control sample, the instructions may indicate that a diagnosis of cancer should be made. In a particular embodiment, if the sample tests positive for an oncogenic Kras gene and for increased expression of one or more of the above polypeptides, the instructions may indicate that diagnosis of cancer may be made. In other embodiments, if one or more of the above-listed polypeptides is determined to have a decreased expression in a sample, e.g., from a patient suspected of having cancer, relative to a control sample, the instructions may indicate that a diagnosis of cancer should be made.

In other embodiments, a kit comprises one or more assays for the detection of one or more metabolites of the invention, such as, e.g., glucose, glucose-6-phosphate (G6P), fructose-6-phosphate (F6P), fructose-1,6-bisphosphate (FBP), phosphoenolpyruvic acid (PEP), and lactate (metabolites of glycolysis); sedoheptulose-7-phosphate (S7P), ribose-5-phosphate (R5P), erythose-4-phosphate (E4P), xylulose-5 phosphate (X5P), and/or sedoheptulose 1,7-bisphosphate (SBP) (metabolites of the non-oxidative arm of the PPP). In a specific embodiment, an assay is a colorimetric assay (e.g., the NAD+/NADH assay kit available from BioAssay Systems, Haywawrd, Calif.). Any suitable metabolite assay known in the art may be comprised in a kit of the invention. Such kits may further comprise instructions for use, wherein if one or more of the above-listed metabolites is determined to have increased expression in a sample, e.g., from a patient suspected of having cancer, relative to a control sample, the instructions may indicate that a diagnosis of cancer should be made. In other embodiments, if one or more of the above-listed metabolites is determined to have decreased expression in a sample, e.g., from a patient suspected of having cancer, relative to a control sample, the instructions may indicate that a diagnosis of cancer should be made.

In accordance with the present invention, there may be employed conventional molecular biology, microbiology, recombinant DNA, immunology, cell biology and other related techniques within the skill of the art. See, e.g., Sambrook et al., (2001) Molecular Cloning: A Laboratory Manual. 3rd ed. Cold Spring Harbor Laboratory Press: Cold Spring Harbor, N.Y.; Sambrook et al., (1989) Molecular Cloning: A Laboratory Manual. 2nd ed. Cold Spring Harbor Laboratory Press: Cold Spring Harbor, N.Y.; Ausubel et al., eds. (2005) Current Protocols in Molecular Biology. John Wiley and Sons, Inc.: Hoboken, N.J.; Bonifacino et al., eds. (2005) Current Protocols in Cell Biology. John Wiley and Sons, Inc.: Hoboken, N.J.; Coligan et al., eds. (2005) Current Protocols in Immunology, John Wiley and Sons, Inc.: Hoboken, N.J.; Coico et al., eds. (2005) Current Protocols in Microbiology, John Wiley and Sons, Inc.: Hoboken, N.J.; Coligan et al., eds. (2005) Current Protocols in Protein Science, John Wiley and Sons, Inc.: Hoboken, N.J.; Enna et al., eds. (2005) Current Protocols in Pharmacology John Wiley and Sons, Inc.: Hoboken, N.J.; Hames et al., eds. (1999) Protein Expression: A Practical Approach. Oxford University Press: Oxford; Freshney (2000) Culture of Animal Cells: A Manual of Basic Technique. 4th ed. Wiley-Liss; among others. The Current Protocols listed above are updated several times every year.

The following examples are meant to illustrate, not limit, the invention.

EXAMPLES

Example 1: Materials and Methods

The following are the materials and methods used in the Examples set forth below.

Generation of Plasmid Construct and Inducible Kras$^{G12D}$ (iKras$^{G12D}$) Transgenic Mice To generate the tetO_Lox-Stop-Lox-Kras$^{G12D}$ transgene, a fragment containing LoxP-Kozak-ATG-Stop sequence was inserted into the EcoRI/NheI site of pTRE-Tight (Clonetech). A splice acceptor sequence was inserted into the NheI/HindIII site of pTRE-Tight and a Stopper-LoxP sequence was inserted into the HindIII/SalI site to generate pTRE-Tight-LSL. The tetO_LSL fragment was isolated from pTRE-tight-LSL with XhoI/SalI digestion and inserted into the XbaI site of pBS-KS containing the SV40 poly(A) sequence inserted into the BamHI site. A fragment containing mutant murine Kras$^{G12D}$ cDNA (see, Johnson et al. (2001) Nature 410:1111-1116) was inserted into the EcoRV site of pKS-Tight-LSL. TetO_LKras$^{G12D}$ mice were produced by injecting the construct into FVB/N blastocysts according to a standard protocol (see, Hofker et al. (2011) Methods in Molecular Biology; 693:352). Transgenic founders were screened by Southern blotting.

p48-Cre, ROSA26-LSL-rtTA-IRES-GFP and p53$^L$ mice have been described previously (see, e.g., Belteki et al. (2005) Nucleic Acids Res 33, e51; Kawaguchi et al. (2002) Nat Genet 32:128-134; Marino et al. (2000) Genes Dev 14, 994-1004). Mice were interbred and maintained on FvB/C57B16 hybrid background in pathogen-free conditions at Dana-Farber Cancer Institute. For doxycycline treatment, mice were fed with doxycycline (Dox) water (doxycycline 2 g/L, sucrose 20 g/L). For BrdU injection, mice were intraperitoneally (i.p.) injected with BrdU at 60 mg/kg every 12 hours for 48 hours before necropsy. All manipulations were performed with IACUC approval protocol number 04116.

Xenograft Studies

For orthotopic xenografts, 5×10$^5$ cells suspended in 10 µl 50% Matrigel (BD Biosciences, Bedford, Mass.)/Hanks Buffered Saline Solution were injected pancreatically into NCr nude mice (Taconic, Hudson, N.Y.). Animals were fed with doxycycline water (doxycycline 2 g/L, sucrose 20 g/L) during the experiment period.

For Sub-Q xenografts, 1×10$^6$ cells suspended in 100 µl Hanks Buffered Saline Solution were injected subcutaneously into the lower flank of NCr nude mice (Taconic). Animals were fed with doxycycline water (doxycycline 2 g/L, sucrose 20 g/L) during the experiment period. Tumor volumes were measured every three days starting from Day 4 post-injection and calculated using the formula Volume=length×width$^2$/2. All xenograft experiments were approved under IACUC protocol 04114.

In Vivo Imaging

MRI imaging was performed using T1-weighted pulse sequences after administration of Gd-DTPA. The imaging system was a 4.7 T Bruker Pharmascan. PET imaging was performed using a Siemens Inveon PET-CT scanner 1 h after injection of approximately 500 µXt of $^{18}$FDG (see, Engelman et al. (2008) Nat Med.; 14(12):1351-1356). Mouse breathing rate was monitored with a BioVet (M2M Imaging), and breathing signal was used to gate the CT.

Immunohistochemistry and Western Blot Analysis

Tissues were fixed in 10% formalin overnight and embedded in paraffin. Immunohistochemical analysis was performed as described (see, Aguirre et al. (2003) Genes Dev 17:3112-3126). The visualization of primary antibodies was performed with horseradish peroxidase system (Vectastain ABC kit, Vector Labs, Inc., Burlingame, Calif.). Images were captured using a Leica DM1400B microsystem and Leica FW4000 version 1.2.1. The primary antibodies used for immunohistochemistry or Western blot were: SMA (NB600-531, Novus Biologicals®, Littleton, Colo.), BrdU (ab1293, Abcam, Cambridge, Mass.), cleaved-Caspase3 (9664, Cell Signaling, Danvers, Mass.), phosphor-Akt (4060, Cell Signaling), phospho-Erk (4376, Cell Signaling), phospho-S6 (4858, Cell Signaling), Actin (sc-1615, Santa Cruz, Santa Cruz, Calif.), Ras (05-516, Millipore, Billerica, Mass.), O-GlcNAc (ab2739, Abcam). Gfpt1 antibody was a kind gift from Immuno-Biological Laboratories Co., Gunma, Japan.

Targeted Liquid-Chromatography Mass Spectrometry (LC/MS/MS)

Two independent iKras p53$^{L/+}$ tumor lines and one LSL-Kras p53$^{L/+}$ line were maintained in basal media in the presence or absence of doxycycline for 24 h. Fresh media was added 2 hours before the experiment. For metabolite collection, media from technical triplicates (in 10 cm dishes at ~70% confluence) was fully aspirated and 4 mL of 80% (v/v) methanol was added at dry ice temperatures. Cells and the metabolite-containing supernatants were collected into conical tubes. Insoluble material in lysates was centrifuged at 2,000×g for 15 min, and the resulting supernatant was evaporated using a refrigerated speed vac. Subsequent metabolite analysis was performed as described before (Locasale et al. (2011) Nature Genetics; 43:869-874). Briefly, samples were re-suspended using 20 ml HPLC grade water for mass spectrometry. Ten microliters were injected and analyzed using a 5500 QTRAP hybrid triple quadrupole mass spectrometer (AB/SCIEX) coupled to a Prominence UFLC HPLC system (Shimadzu) via selected reaction monitoring (SRM) of a total of 254 endogenous water soluble metabolites for steady-state analyses of samples. Some metabolites were targeted in both positive and negative ion mode for a total of 285 SRM transitions using positive/negative switching. ESI voltage was +4900 V in positive ion mode and −4500 V in negative ion mode. The dwell time was 4 ms per SRM transition and the total cycle time was 1.89 s. Approximately 9-12 data points were acquired per detected metabolite. Samples were delivered to the MS via normal phase chromatography using a 4.6 mm i.d×10 cm Amide Xbridge HILIC column (Waters Corp.) at 300 ml/min. Gradients were run starting from 85% buffer B (HPLC grade acetonitrile) to 42% B from 0-5 min; 42% B to 0% B from 5-16 min; 0% B was held from 16-24 min; 0% B to 85% B from 24-25 min; 85% B was held for 7 min to re-equilibrate the column. Buffer A was comprised of 20 mM ammonium hydroxide/20 mM ammonium acetate (pH=9.0) in water:acetonitrile (95:5). Peak areas from the total ion current for each metabolite multiple reaction monitoring (MRM) transition were integrated using MultiQuant v1.1 software (Applied Biosystems, Austin, Tex.). Data analysis was performed in Cluster3.0 and TreeViewer.

Isotope Labeling and Kinetic Profiling

Glucose- or glutamine-free RPMI was supplemented with 10% dialyzed serum and 1,2-$^{13}$C$_2$-glucose, U-$^{13}$C$_6$-glucose, or U-$^{13}$C$_5$-glutamine (Cambridge Isotope Labs, Andover, Mass.) to 11 mM (for glucose) or 2 mM (for glutamine). Cells were maintained in the presence or absence of doxycycline for 24 hours, at which point labeled media was added to technical triplicates (in 10 cm dishes at ~70% confluence). For flux analysis, cells were maintained in the presence or absence of doxycycline for 24 hours and then media was replaced with that containing uniformly-labeled glucose (U-$^{13}C_6$-glucose) or 1,2-$^{13}$C glucose. Cells were quickly harvested at the given time points using the above mentioned protocol.

1-$^{14}$C/6-$^{14}$ Glucose Incorporation into Nucleotides

Cells were maintained in the presence or absence of doxycycline for 24 hours, at which point technical triplicates (in 10 cm dishes at ~70% confluence) were treated with 1 µCi 1-$^{14}$C or 6-$^{14}$C glucose. 24 h later, the cells were trypsinized, the volume was distributed into halves and the cells were pelleted. DNA or RNA were isolated with Qiagen kits (Valencia, Calif.) according to the manufacturer's instructions and quantified using a NanoDrop instrument. Equal volumes of DNA/RNA were added to scintillation vials and radioactivity was measured by liquid scintillation counting and normalized to the DNA/RNA concentration from the NanoDrop measurement.

$^{14}$C Glucose Incorporation into in $CO_2$

Cells were maintained in the presence or absence of doxycycline for 24 hours, at which point technical triplicates (3 wells of a 12-well dish per condition at ~70% confluence) were treated with 1 µCi 1-$^{14}$C or 6-$^{14}$C glucose and incubated at 37° C. for the indicated time points. To release $^{14}CO_2$, 150 µl of 3M perchloric acid was added to each well and immediately covered with phenylethylamine saturated Whatman paper. The 12-well dishes were incubated at room temperature overnight, after which the Whatman paper was removed, placed into scintillation vials containing 5 mL of scintillation fluid and $^{14}$C counts were read with a scintillation counter.

Metabolite Analysis of Spent Medium

Cells were seeded in 12-well plates in triplicate for 24 hours followed by culture in doxycycline-free medium or medium containing doxycycline for additional 24 hours. Glucose and lactate concentrations were measured in fresh and spent medium using a Yellow Springs Instruments (YSI) 7100. Glucose data is presented as net decrease in concentration, and lactate as net increase in concentration after normalization to cell numbers.

Clonogenic Assay 400 cells were seeded into each well of 6-well plate in duplicate and colonies were stained 7-10 days later with 0.2% crystal violet in 80% methanol.

Anchorage-Independent Growth Assay 10,000 cells per well were seeded in medium containing 0.4% low-melting agarose on top of bottom agar containing 1% low-melting agarose in regular medium. After 14-21 days, colonies were stained with iodonitrotetrazoliumchloride (Sigma, St. Louis, Mo.) and counted with TotalLab TL100 software (Hoefer, Holliston, Mass.).

Expression Profiling and Bioinformatics Analysis mRNA expression profiling was performed at the Dana-Farber Microarray Core facility using the Mouse Genome 430 2.0 Array (Affymetrix, Santa Clara, Calif.). To identify differentially expressed genes between doxycycline treatment and withdrawal, the raw intensities were log$_2$-transformed and quantile normalized. The software package LIMMA (Linear Models for Microarray Data) (Smyth, G. K. (2004) Stat Appl Genet Mol Biol 3, Article3) was applied to detect significantly differentially expressed probes using Benjamini-Hochberg adjusted P-values. Complete profiles are available at GEO (The Gene Expression Omnibus (GEO), available on line at, http://www.ncbi.nlm.nih.gov/geo/) at GSE23926. For gene set enrichment analysis (GSEA) (see, Subramanian et al. (2005) Proc Natl Acad Sci USA 102:15545-15550), gene set collections from MSigDB 3.0 and Kyoto Encyclopedia of Genes and Genomes (KEGG) were included in the analysis.

Lentiviral-Mediated shRNA Targeting

Lentiviral shRNA clones targeting Gfpt1, RPIA, RPE, MYC, and FASN and nontargeting control construct shGFP were obtained from the RNAi Consortium at the Dana-Farber/Broad Institute. The clone IDs and nucleic acid sequences for the shRNAs are:

```
                                         (SEQ ID NO: 165)
TRCN0000031644 (shGfpt1-1): CCTGAAACTTAAGACAGTTAA;

(SEQ ID NO: 166)
TRCN0000031645 (shGftp1-2): CGTCTCTCTATCCACCGAATT;

(SEQ ID NO: 167)
TRCN0000031648 (shGfpt1-3): CAGGGCATTCTCAGTGTGATT;

(SEQ ID NO: 168)
TRCN0000181768 (shRPIA): GCAGCGAATAGCTGAAAGAGT;

(SEQ ID NO: 169)
TRCN0000186910 (shRPE): GCCTGAGAATATGAATGGAAT, (SEQ ID NO: 170)
TRCN0000042514 (shMyc-1): GCCTACATCCTGTCCATTCAA;

(SEQ ID NO: 171)
TRCN0000042517 (shMyc-2): GCTTCGAAACTCTGGTGCATA;

(SEQ ID NO: 172)
TRCN0000075703 (shFasn-1): GCTGGTCGTTTCTCCATTAAA;

(SEQ ID NO: 173)
TRCN0000075704 (shFasn-2): CCCTTGATGAAGAGGGATCAT;

(SEQ ID NO: 174)
TRCN0000075705 (shFasn-3): CGTCGTCTATACCACTGCTTA;

(SEQ ID NO: 175)
TRCN0000075706 (shFasn-4): CGTCTATACCACTGCTTACTA;
and
                                         (SEQ ID NO: 176)
TRCN0000075707 (shFasn-5): GCTGCGGAAACTTCAGGAAAT.
```

Lentiviruses were produced in 293T cells with packing mix (ViraPower Lentiviral Expression System, Invitrogen, Carlsbad, Calif.) as per manufacturer's instruction. 293T cell supernatant containing the shRNA lentivirus was collected, filtered through 0.45 µm filter, and added to target iKras cells in the presence of 8 µg/ml polybrene.

Establishment of Primary Pancreatic Adenocarcinoma Cell Lines

Establishment of primary PDAC lines were performed as described (see, Aguirre et al. (2003), supra). Cells were maintained in RPMI1640 medium containing 10% FBS and 1 µg/ml doxycycline.

In Silico Cis-Element Analysis

Gene expressions were modeled using dChip software. Sets of genes differentially expressed pre- and post-differentiation induction were generated using the SAM statistic, with a cut off of 62.0. Promoter analysis on both these gene sets used the CisGenome software (http://biogibbs.stanford.edu/~jihk/CisGenome/index.htm) to scan the 8 kb upstream to 2 kb downstream regions of these genes for the ~550 motifs in the TRANSFAC 12.1 database. Enrichment was measured against control regions at a comparable distance from the transcription start sites of random genes.

Reagents

Doxycycline (Research Product International), BSO (Sigma), Ras activation assay kit (Millipore), G6PD activity assay kit (BioVision), GSH/GSSG-Glo™ assay kit (Promega, Madison, Wis.).

Statistical Analysis

Tumor-free survivals were analyzed using GraphPad Prism® 4 (GraphPad Software, Inc., La Jolla, Calif.). Statistical analyses were performed using nonparametric Mann-Whitney test. Other comparisons were performed using the unpaired Student's t-test. For all experiments with error bars, standard deviation was calculated to indicate the variation within each experiment and data, and values represent mean±standard deviation (s.d.).

Example 2: Generation and Analysis of Inducible Kras$^{G12D}$ Knock-in Mice

This example demonstrates that Kras$^{G12D}$ is essential for PDAC maintenance.

To control Kras$^{G12D}$ expression in a temporal and tissue specific manner, a conditional Kras$^{G12D}$ transgene under the control of a tet-operator with a lox-stop-lox (LSL) cassette inserted between the promoter and the start codon of the Kras$^{G12D}$ open reading frame (tetO_Lox-Stop-Lox-Kras$^{G12D}$, designated tetO_LKras$^{G12D}$) was generated (FIG. 1). Mice carrying tetO_LKras$^{G12D}$ were crossed with those harboring ROSA26-LSL-rtTA-IRES-GFP (ROSA_rtTA) and p48-Cre to enable pancreas-specific and doxycycline-inducible expression of Kras$^{G12D}$; this triple transgenic strain is designated hereafter as iKras.

Figure 2:
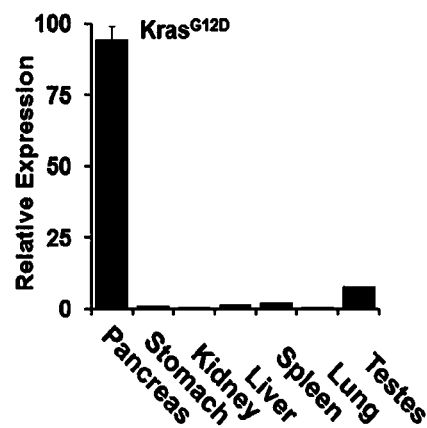
FIG. 2 is a bar graph quantifying relative mRNA expression of $Kras^{G12D}$ in the pancreas, stomach, kidney, liver, spleen, lung and testes of p48-Cre tetO_LKrasG12D ROSA_rtTA mice (n=3) fed with doxycycline-containing water for 2 weeks starting at 3 weeks of age.
Figure 3:
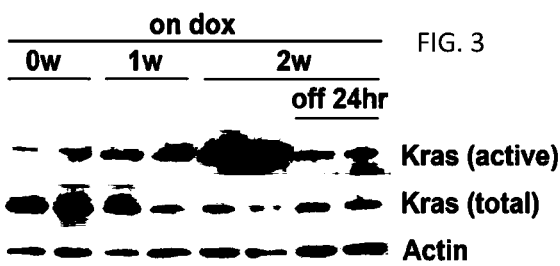
FIG. 3 is a photograph of a Western blot showing pancreatic Ras activity (active Kras and total Kras) measured by Raf-RBD pull down assay in samples from pancreatic tissue lysate prepared from p48-Cre tetO_LKrasG12D ROSA_rtTA mice fed with doxycycline-containing water for the indicated time period (0 weeks (w)), after 1 week of doxycycline treatment (1 w), after 2 weeks of doxycycline treatment (2 w), and after 2 w of treatment with doxycycline followed by 24 hours (hr) off doxycycline (off 24 hr)). Actin was used as a gel loading control.
Figure 4:
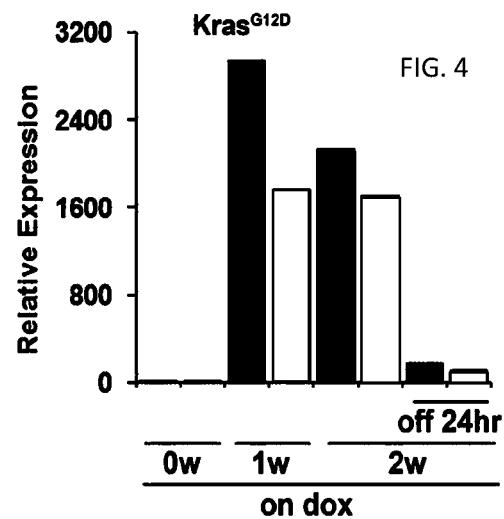
FIG. 4 and FIG. 5 are bar graphs quantifying the relative mRNA expression of $Kras^{G12D}$ (FIG. 4) and total Kras (FIG. 5), determined by QPCR using transgene-specific primers (FIG. 4) or primers common to both the wild-type and transgenic alleles (FIG. 5), in total pancreatic RNA prepared from p48-Cre tetO_LKrasG12D ROSA_rtTA mice fed with doxycycline-containing water for the indicated time period (at the beginning of doxycycline treatment (0 weeks (w)), after 1 week of doxycycline treatment (1w), after 2 weeks of doxycycline treatment (2 w), and after 2w of treatment with doxycycline followed by 24 hours (hr) off doxycycline (off 24 hr)).
Figure 5:
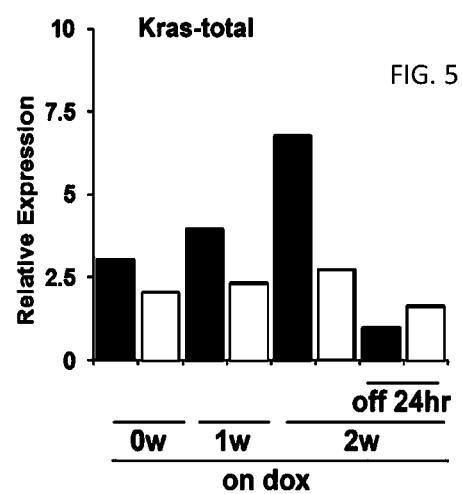

Kras$^{G12D}$ expression was measured by QPCR with transgene-specific primers in tissues from iKras mice (n=3) fed with doxycycline-containing water for 2 weeks starting at 3 weeks of age. The mice exhibited pancreas-specific expression of Kras$^{G12D}$ (FIG. 2). Doxycycline treatment effectively induced Kras expression and activity as documented by Raf-RBD pull-down assay (FIGS. 3 and 4), but did not substantially increase total Kras expression at the mRNA or protein levels (FIGS. 5 and 3, respectively). Extinction of the Kras$^{G12D}$ transgene occurred within 24 hours following doxycycline withdrawal (FIGS. 3 and 4).

Figure 6:
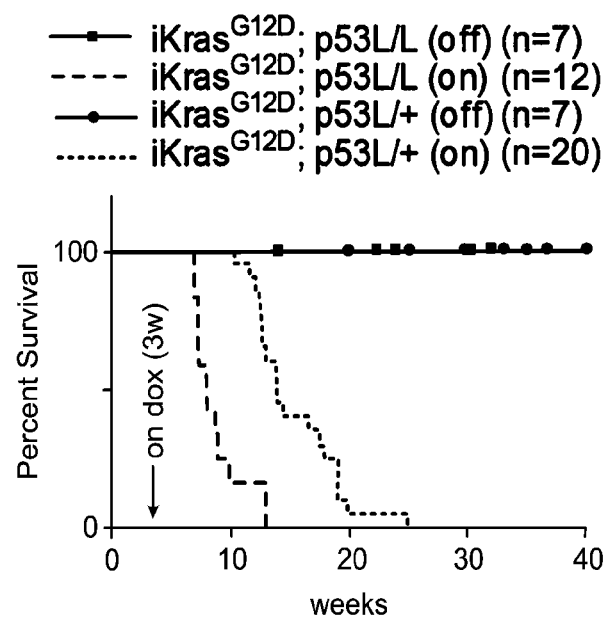
FIG. 6 is a Kaplan-Meier overall survival analysis for $iKras^{G12D}$; p53L/L and iKrasG12D; p53L/+ mice continuously fed ("on") or not fed ("off") doxycycline. Length of survival is shown in weeks on the x-axis and the percent survival is shown on the y-axis; "n" indicates the number of mice in each group.

Consistent with the role of Kras$^{G12D}$ as a driver of PDAC initiation, doxycycline induction provoked acinar-to-ductal metaplasia (ADM) and PanIN lesions within 2 weeks. Similar to the LSL-Kras$^{G12D}$ knock-in model, induction of the Kras$^{G12D}$ transgene leads to infrequent occurrence of invasive PDAC after long latency (35-70 weeks), suggesting comparable biological activity of the Kras$^{G12D}$ alleles and the need for additional genetic events for tumor progression. To enable full malignant progression and assess the tumor maintenance role of Kras$^{G12D}$ in advanced malignancies, iKras and conditional p53 knockout (p53$^L$) alleles were crossed. Following initiation of doxycycline treatment at 3 weeks of age, all iKras p53$^{L/+}$ mice succumbed to PDAC development between 11 to 25 weeks of age (median survival=15 weeks of age), whereas the doxycycline-treated iKras p53$^{L/L}$ mice succumbed to PDAC more rapidly with a median survival of 7.9 weeks (FIG. 6).

The iKras p53 mutant tumors exhibited features commonly found in human PDAC, including glandular tumor structures, exuberant stromal formation, local invasion into surrounding structures such as the duodenum, and distant metastases to the liver and lung. Histological analysis documented invasive PDAC in 8/8 iKras p53$^{L/+}$ mice at 8 weeks after induction. As such, the impact of Kras$^{G12D}$ extinction on tumor biology and maintenance was assessed at 9 weeks after induction. Kras$^{G12D}$ extinction led to rapid tumor regression with morphological deterioration of tumor cells and rapid degeneration of stromal elements starting 48 hours and peaking at 72 hours following doxycycline withdrawal. At 1 week following doxycycline withdrawal, MRI scans showed an approximate 50% reduction in tumor mass, whereas PET/CT showed complete loss of the baseline fluorodeoxyglucose (FDG) uptake. On the histopathological level, virtually all malignant components of the tumor regressed with the remaining pancreata displaying collagen deposition surrounding the few remnant ductal structures. Correspondingly, tumor regression was accompanied by decreased tumor cell proliferation (BrdU incorporation) and increased apoptosis (Caspase-3 activation) 2-3 days after doxycycline withdrawal, culminating in complete loss of tumor cell proliferation at 1 week following doxycycline withdrawal. Moreover, Kras$^{G12D}$ extinction effected dramatic changes in the tumor stroma as evidenced by a reduction in pancreatic stellate cells (as determined by SMA staining), which are a prominent component of the classical stromal reaction in PDAC. These in vivo findings paralleled cell culture-based assays including loss of clonogenic growth of early passage primary tumor cells, consistent with a role for cell-autonomous mechanisms contributing to tumor regression. Together, these findings established that Kras$^{G12D}$ expression is required for PDAC maintenance in this autochthonous model, supporting both the proliferation and viability of tumor cells and its associated stroma.

Figure 7:
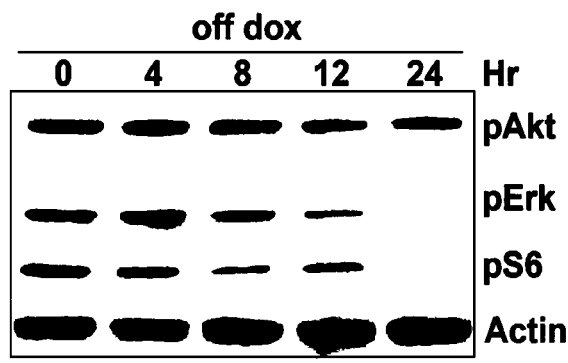
FIG. 7 and FIG. 8 are photographs of Western blots for phospho-Akt, phospho-Erk and phospho-S6 in lysates from iKras p53L/+ PDAC cells pulled off doxycycline treatment for the indicated number of hours (0, 4, 8, 12 or 24) (FIG. 7) and in iKras p53L/+ (iKras-1 and iKras-2) or constitutive LSL-KrasG12D p53L/+ control (LSL-Kras) PDAC cell lines cultured in the presence or absence of doxycycline for 24 hours.
Figure 8:
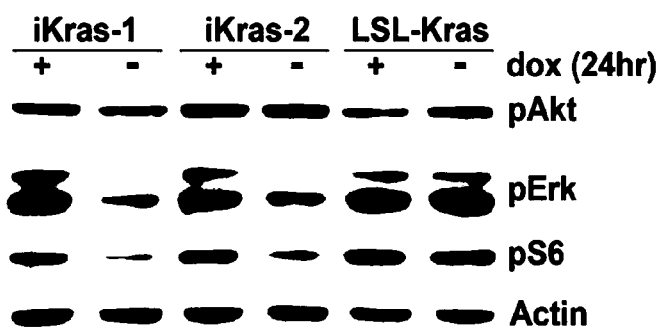

These biological changes aligned with changes in prototypical Kras signaling components, including a decrease in MAPK signaling as measured by phospho-Erk staining as early as 24 hr following doxycycline withdrawal, preceding any obvious changes in tumor morphology. Decreased phospho-Erk was followed by dampened mTOR signaling, as evidenced by decreased phospho-S6 staining in tumor cells, although the phospho-S6 signal remained high in some stromal cells. These in vivo signaling patterns matched those seen in cultured tumor cells (FIG. 7). As expected, LSL-Kras$^{G12D}$ p53$^{L/+}$ primary tumor cell cultures showed no doxycycline-dependent signaling changes (FIG. 8).

Example 3: Transcriptomic Analysis Using Orthotopic iKras$^{G12D}$ p53-Null Tumors This example demonstrates that Kras$^{G12D}$ regulates multiple metabolic pathways at the transcriptional level.

Figure 9:
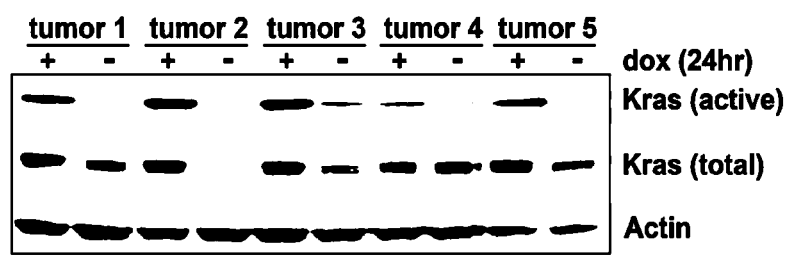
FIG. 9 is a photograph of a Western blot for pancreatic Ras activity (active Kras and total Kras) measured with Raf-RBD pull down assay in samples from orthotopic xenograft tumors generated from five independent primary iKras p53L/+ PDAC cell lines. Animals were kept on doxycycline for 2 weeks until tumors were fully established. Half of the animals were pulled off doxycycline treatment for 24 hours prior to tumor isolation (indicated by "−" for dox (24 hr), animals that continued to receive doxycycline are indicated by "+"), at which point tumor lysates were prepared from both cohorts.
Figure 10:
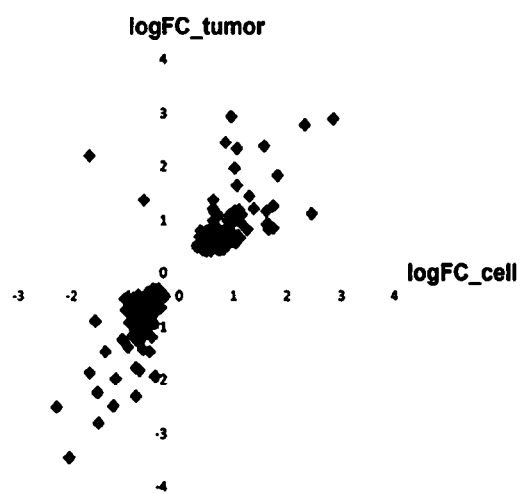
FIG. 10 is a dot plot showing correlation of expression levels of differentially expressed genes obtained from xenograft transcriptome ("tumor") or transcriptome of cultured parental lines ("cell") upon doxycycline withdrawal. Data are plotted as $\log_2$ fold change ("log FC") of the expression of the genes in tumors (y-axis) versus in cells (x-axis). Positive values indicate increases in expression level and negative values indicate decreases in expression.
Figure 11:
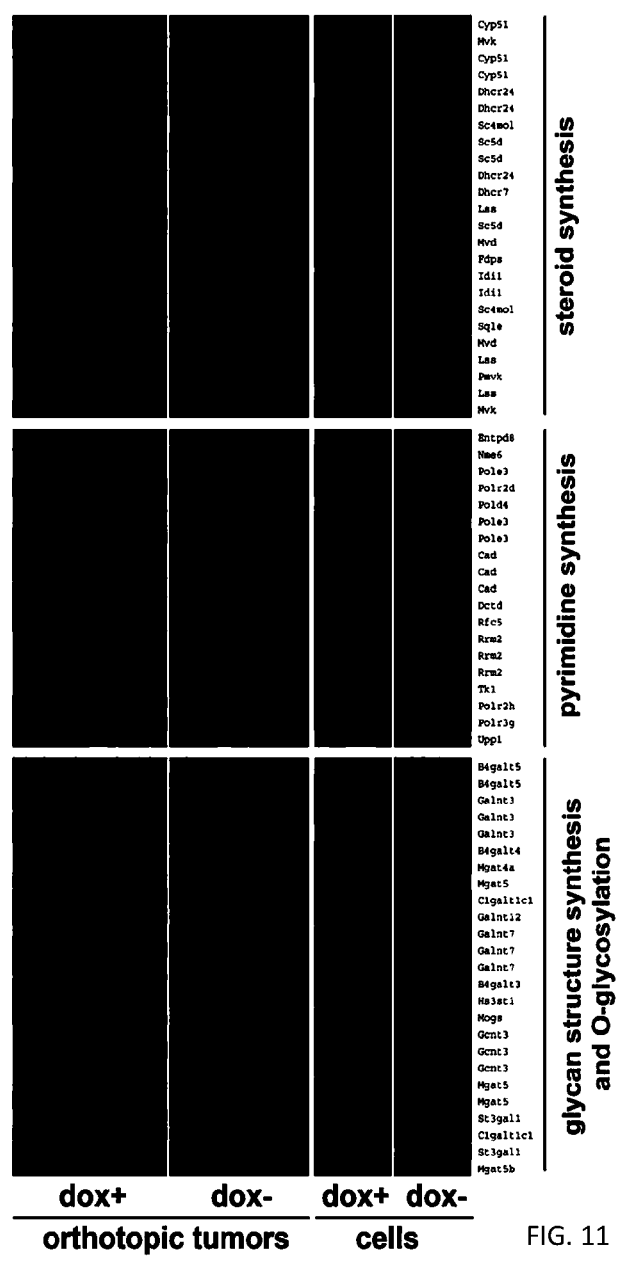
Figure 12A:
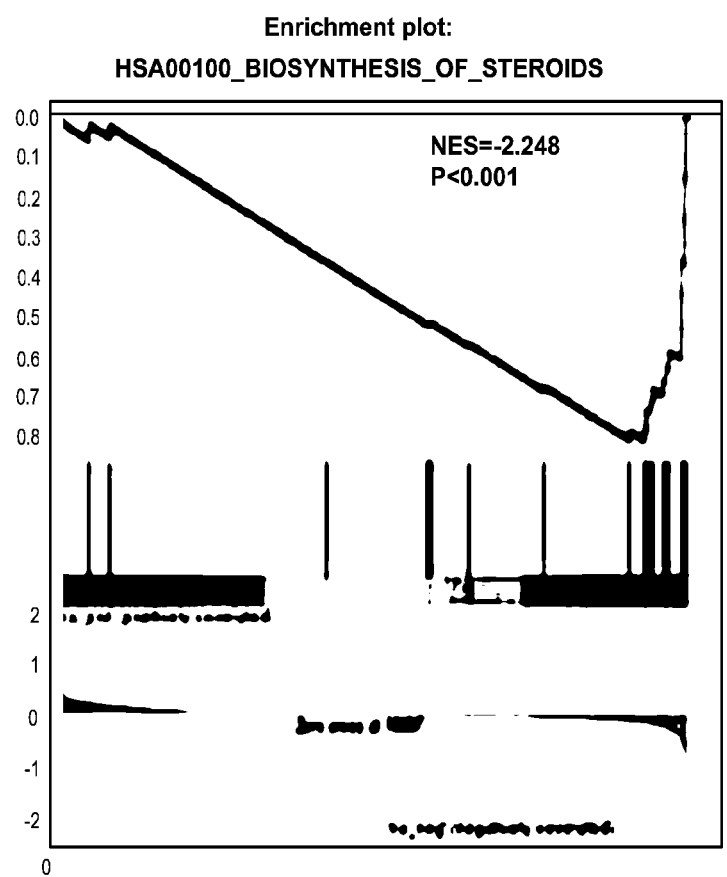
FIGS. 12A-12C are a series of gene set enrichment analysis (GSEA) plots of steroid biosynthesis (FIG. 12A), pyrimidine metabolism (FIG. 12B) and O-glycan biosynthesis (FIG. 12C) pathways based on the off-doxycycline versus on-doxycycline gene expression profiles shown in FIG. 11. "NES" denotes normalized enrichment score and P values show statistical significance, with P≤0.05 considered statistically significant.
Figure 12B:
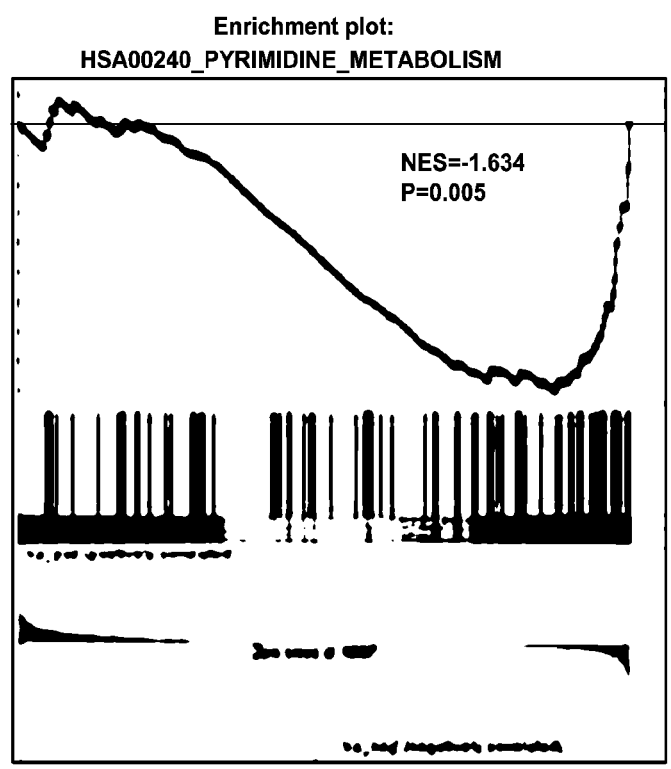
Figure 12C:
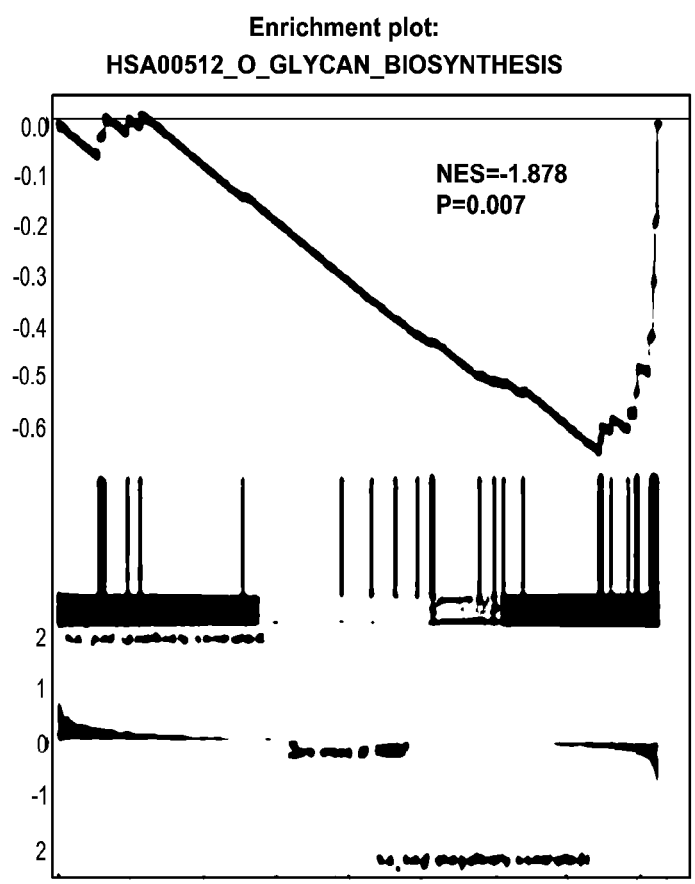

To gain further mechanistic insight into Kras$^{G12D}$-mediated tumor maintenance, beyond the classical signaling pathways, transcriptomic analysis was conducted using orthotopic iKras$^{G12D}$ p53 null tumors generated from 5 independent primary tumor lines. Importantly, these orthotopic tumors faithfully recapitulated histological and molecular features of the primary tumors. To audit proximal molecular changes linked to Kras$^{G12D}$ extinction, tumors were harvested at 24 hours following doxycycline withdrawal, as this time point showed documented loss of Ras activity, as shown by decreased binding to Raf-RBD in the pull-down assay (FIG. 9), yet absence of morphological changes. To exclude possible doxycycline-induced transcriptomic changes, parallel studies were conducted with 2 independent primary LSL-Kras$^{G12D}$ p53 null tumor lines, which confirmed minimal doxycycline-dependent changes. Moreover, xenograft tumors and cultured parental lines exhibited significant correlation in expression levels for the differentially expressed genes upon Kras$^{G12D}$ extinction (FIG. 10), suggesting that the cultured tumor cell lines may serve to complement tumor studies in vivo. As shown in FIGS. 11 and 12 and Table 3, below, Gene Set Enrichment Analysis (GSEA) of the in vivo and in vitro Kras$^{G12D}$ transcriptome using the KEGG gene sets showed striking representation of metabolic processes including the downregulation of steroid biosynthesis, pyrimidine metabolism, O-glycan biosynthesis and glycan structures biosynthesis pathways.

Figure 18:
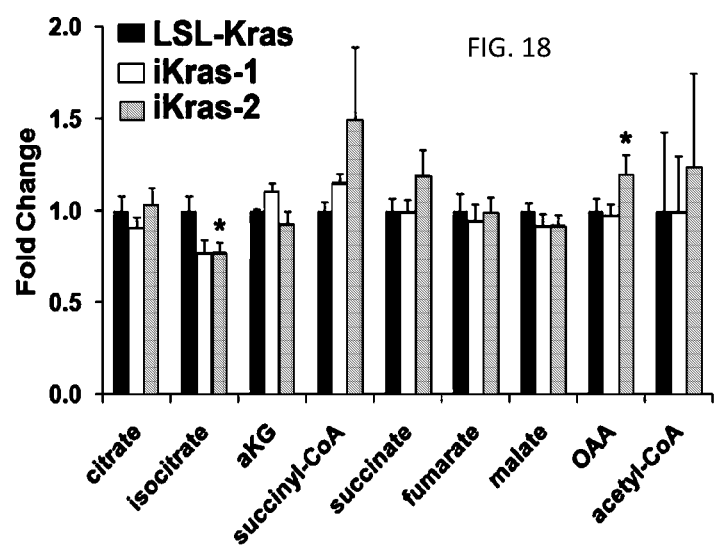
FIG. 18 is a bar graph showing the fold change in levels of the indicated metabolites in TCA cycle (citrate, isocitrate, aKG, succinyl-CoA, succinate, fumarate, malate, oxaloacetate (OAA), and acetyl-CoA) 24 hours after doxycycline withdrawal in iKras p53L/+ cells PDAC tumor cells (iKras-1 and iKras-2) relative to levels in constitutive LSL-KrasG12D p53L/+ control cells (LSL-Kras); statistical significance is indicated as follows: *: $p<0.05$.

Interestingly, it was also observed that $Kras^{G12D}$ inactivation was not accompanied by significant alterations to TCA cycle intermediates (FIG. 18). This finding is consistent with a

TABLE 3

List of negatively enriched KEGG pathways from GSEA

|  | SIZE | NES | NOM p-val |
|---|---|---|---|
| Tumors |  |  |  |
| HSA00100_BIOSYNTHESIS_OF_STEROIDS | 23 | −2.2477 | 0.0000 |
| HSA04640_HEMATOPOIETIC_CELL_LINEAGE | 71 | −1.9591 | 0.0000 |
| HSA04060_CYTOKINE_CYTOKINE_RECEPTOR_INTERACTION | 196 | −1.5049 | 0.0000 |
| HSA00561_GLYCEROLIPID_METABOLISM | 50 | −2.0310 | 0.0025 |
| HSA00240_PYRIMIDINE_METABOLISM | 81 | −1.6338 | 0.0055 |
| HSA01030_GLYCAN_STRUCTURES_BIOSYNTHESIS_1 | 93 | −1.5144 | 0.0059 |
| HSA04940_TYPE_I_DIABETES_MELLITUS | 19 | −1.7684 | 0.0068 |
| HSA00512_O_GLYCAN_BIOSYNTHESIS | 25 | −1.8777 | 0.0075 |
| HSA04012_ERBB_SIGNALING_PATHWAY | 83 | −1.5465 | 0.0088 |
| HSA00030_PENTOSE_PHOSPHATE_PATHWAY | 22 | −1.5520 | 0.0178 |
| HSA04630_JAK_STAT_SIGNALING_PATHWAY | 122 | −1.4413 | 0.0199 |
| HSA05216_THYROID_CANCER | 27 | −1.5886 | 0.0252 |
| HSA04080_NEUROACTIVE_LIGAND_RECEPTOR_INTERACTION | 217 | −1.2743 | 0.0281 |
| HSA00330_ARGININE_AND_PROLINE_METABOLISM | 28 | −1.5047 | 0.0313 |
| HSA01031_GLYCAN_STRUCTURES_BIOSYNTHESIS_2 | 57 | −1.4673 | 0.0330 |
| HSA03050_PROTEASOME | 21 | −1.5630 | 0.0409 |
| CULTURED PARENTAL CELLS |  |  |  |
| HSA00100_BIOSYNTHESIS_OF_STEROIDS | 23 | −2.2434 | 0.0000 |
| HSA00670_ONE_CARBON_POOL_BY_FOLATE | 15 | −1.8559 | 0.0099 |
| HSA00512_O_GLYCAN_BIOSYNTHESIS | 25 | −1.8467 | 0.0000 |
| HSA01030_GLYCAN_STRUCTURES_BIOSYNTHESIS_1 | 93 | −1.6014 | 0.0000 |
| HSA00602_GLYCOSPHINGOLIPID_BIOSYNTHESIS_NEO_LACTOSERIES | 18 | −1.5705 | 0.0372 |
| HSA03010_RIBOSOME | 47 | −1.5508 | 0.0144 |
| HSA00240_PYRIMIDINE_METABOLISM | 81 | −1.3951 | 0.0207 |

Table 3 Legend: Negatively enriched KEGG pathways are shown in column 1 (identified by unique KEGG identifier numbers) for tumors and cultured parental cells; "size" (column 2): the number of genes included the gene set; "NES" (column 3): normalized enrichment score; "NOM p-val"(column 4): statistical significance (nominal p-value).

Example 4: Metabolomic Studies Following $Kras^{G12D}$ Extinction

This example demonstrates that $Kras^{G12D}$ enhances glycolytic flux.

Figure 13:
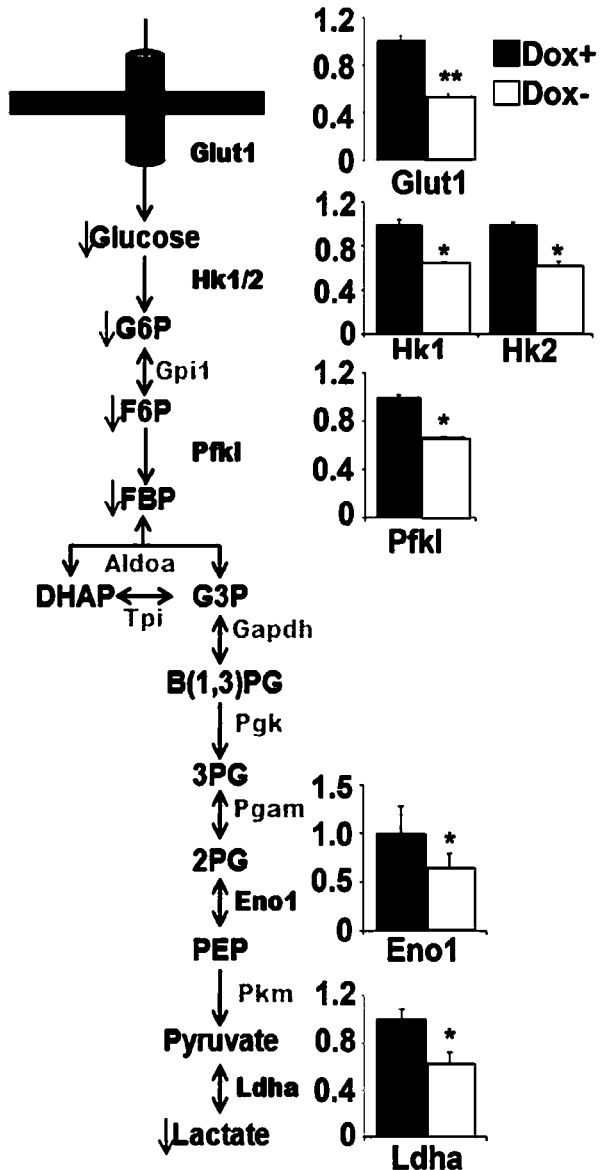
FIG. 13 is a schematic diagram (left panel) summarizing the changes in glycolysis upon $Kras^{G12D}$ inactivation and bar graphs (right panel) quantifying the change in expression of specific enzymes in the pathway. Metabolites that decreased upon doxycycline withdrawal are indicated with downward arrows (glucose, G6P, F6P, FBP and lactate). The bar graphs (right panel) indicate the relative mRNA expression levels of differentially expressed glycolytic enzymes (GLUT1, HK1, HK2, PFKL, ENO1 and LDHA) that showed a significant decrease (as indicated by "*") in the absence of doxycycline; the gene names for those enzymes that exhibited significant changes are also boxed in the diagram. In the diagram, glycolytic enzymes whose change in expression was not significant are shown but not boxed.
Figure 14:
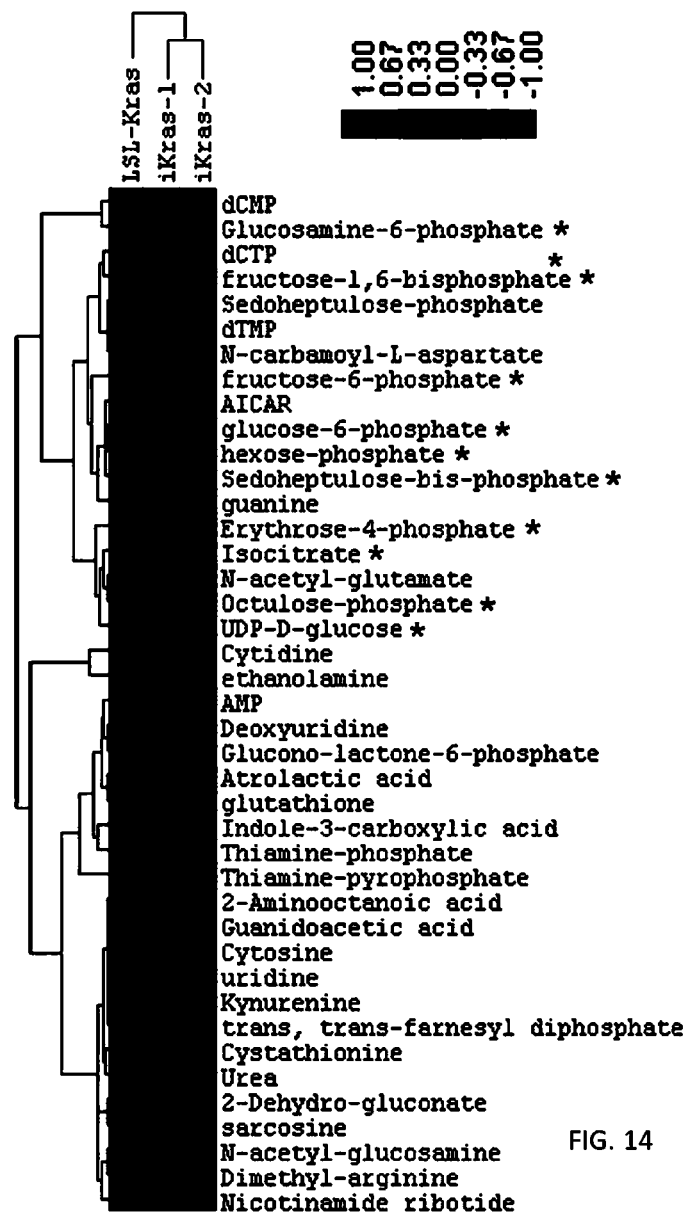
FIG. 14 is a heat map of metabolites that are significantly and consistently changed upon doxycycline withdrawal between the two iKras p53L/+ lines (iKras-1 and iKras-2) relative to constitutive LSL-KrasG12D p53L/+ controls (LSL-Kras). Cells were maintained in the presence or absence of doxycycline for 24 hours, at which point metabolite levels were measured from technical triplicates for each treatment condition. The averaged ratios of off-doxycycline over on-doxycycline levels for differentially regulated metabolites are represented in the heat map. Asterisks indicate metabolites involved in glucose metabolism that significantly decrease upon doxycycline withdrawal (Kras extinction).
Figure 15:
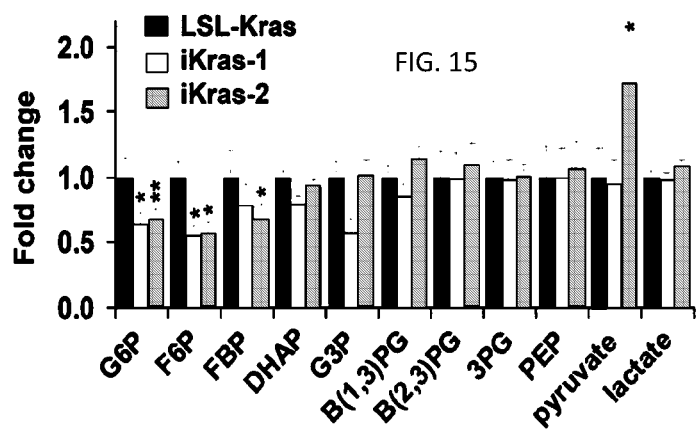
FIG. 15 is a bar graph quantifying the fold changes of glycolytic intermediates upon doxycycline withdrawal for 24 hours in iKras p53L/+ lines (iKras-1 and iKras-2) relative to constitutive LSL-KrasG12D p53L/+ controls (LSL-Kras); statistical significance is indicated as follows: *: $p<0.05$.
Figure 16A:
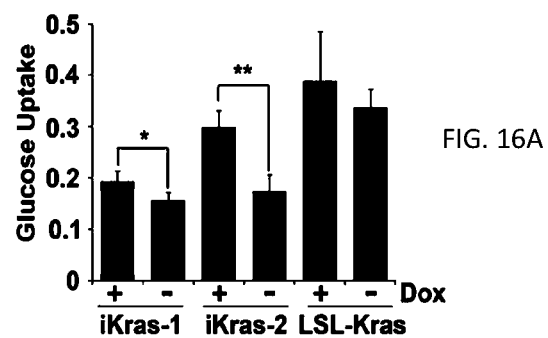
FIGS. 16A and 16B are bar graphs quantifying the relative changes of glucose (16A) or lactate (16B) levels in the medium from iKras p53L/+ cells (iKras-1 and iKras-2) or constitutive LSL-KrasG12D p53L/+ control cells (LSL-Kras) maintained in the presence or absence of doxycycline for 24 hours, normalized to total cell numbers; statistical significance is indicated as follows: *: $p<0.05$; **: $p<0.01$.
Figure 16B:
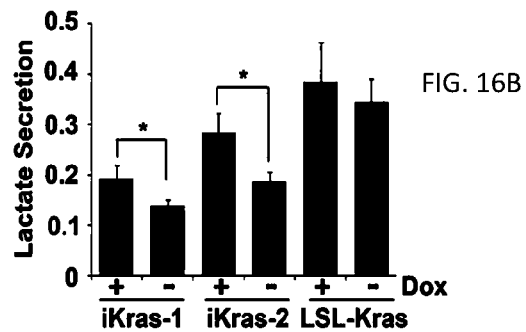

To confirm the role of $Kras^{G12D}$ in regulation of tumor cell metabolism in this model system, metabolomic studies were performed to comprehensively characterize metabolic alterations immediately following $Kras^{G12D}$ extinction. While doxycycline withdrawal showed negligible metabolite changes in the constitutive LSL-$Kras^{G12D}$ $p53^{L/+}$ controls, extinction of $Kras^{G12D}$ in the iKras $p53^{L/+}$ model effected significant metabolic changes involving multiple pathways, the most significant of which were intermediates from pathways involving glucose metabolism (FIGS. 13 and 14). $Kras^{G12D}$ extinction was accompanied by significant downregulation of glucose-6-phosphate (G6P), fructose-6-phosphate (F6P) and fructose-1,6-bisphosphate (FBP) with minimal changes to the remaining components in glycolysis (FIG. 15). In addition, $Kras^{G12D}$ extinction led to decreased glucose uptake and lactate production (FIGS. 16A and 16B), demonstrating that oncogenic $Kras^{G12D}$ enhances glycolytic flux in tumor cells.

Figure 17:
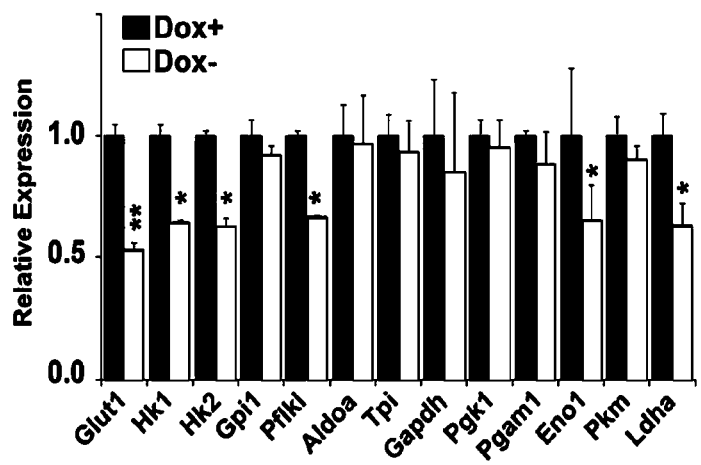
FIG. 17 is a bar graph quantifying the relative mRNA expression of the indicated glycolysis genes (GLUT1, HK1, HK2, GPI1, PFKL, ALDOA, TPI, GAPDH, PGK1, PGAM1, ENO1, PKM and LDHA) in the presence of doxycycline (Dox+) or 24 hours after doxycycline withdrawal (Dox−) in iKras p53L/+ cells PDAC tumor cells; statistical significance is indicated as follows: *: $p<0.05$; **: $p<0.01$.
Figure 19:
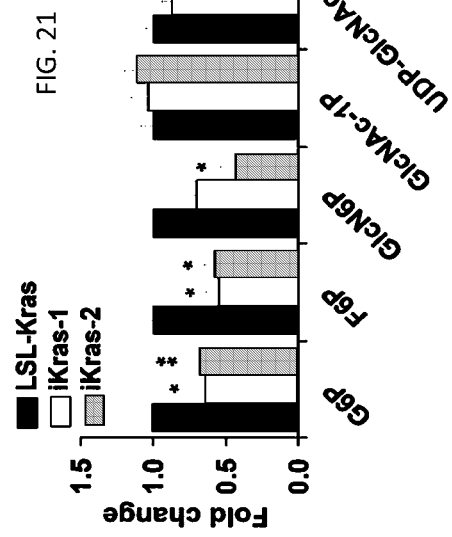
FIG. 19 is a bar graph quantifying the percentage (%) of uniformly U-$^{13}$C-isotope-labeled TCA cycle intermediates (citrate, isocitrate, α-ketoglutarate, succinate, fumarate, malate, oxaloacetate, glutamate, aspartate, N-acetyl-glutamate, N-acetyl-glutamine) that derive from either glutamine or glucose in iKras p53L/+ PDAC cells cultured in the presence of either U-$^{13}$C glucose (white bars) or U-$^{13}$C glutamine (black bars) with doxycycline for 24 h.

These metabolic changes corresponded precisely with those from the transcriptional profiles, which showed downregulation of the glucose transporter (GLUT1/Slc2a1) and several key glycolytic enzymes HK1, HK2 and PFKL, as well as LDHA, the enzyme responsible for converting pyruvate to lactate (FIGS. 13 and 17). These data strongly suggested that $Kras^{G12D}$ is essential for glucose utilization in this model through the regulation of multiple rate-limiting steps during glucose uptake and subsequent metabolism.

model whereby proliferating cells divert glucose metabolites into anabolic processes (e.g., nucleotide and lipid biosynthesis), while alternative carbon sources are utilized to fuel the TCA cycle. Indeed, glutamine was the major carbon source in the $Kras^{G12D}$-driven PDAC cells, as shown by U-$^{13}C_6$-glucose and U-$^{13}C_6$-glutamine labeling (FIG. 19).

Figure 47:
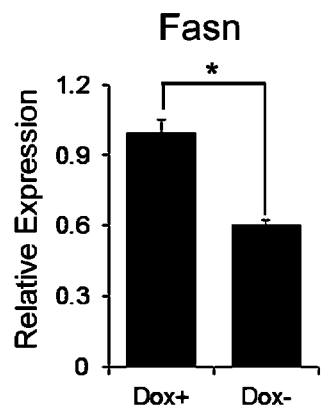
FIG. 47 is a bar graph quantifying the relative mRNA expression level of FASN in the presence (Dox+) or absence (Dox−) of doxycycline for 24 hours; *p<0.05.

It was also determined that expression of fatty acid synthase (FASN), an enzyme involved in fatty acid synthesis, was downregulated upon $Kras^{G12D}$ inactivation in iKras p53L/+ PDAC cells (FIG. 47).

Example 5: $Kras^{G12D}$ in Hexosamine Biosynthesis Pathway and Protein Glycosylation This example demonstrates that $Kras^{G12D}$ activates the hexosamine biosynthesis pathway and protein glycosylation.

Figure 21:
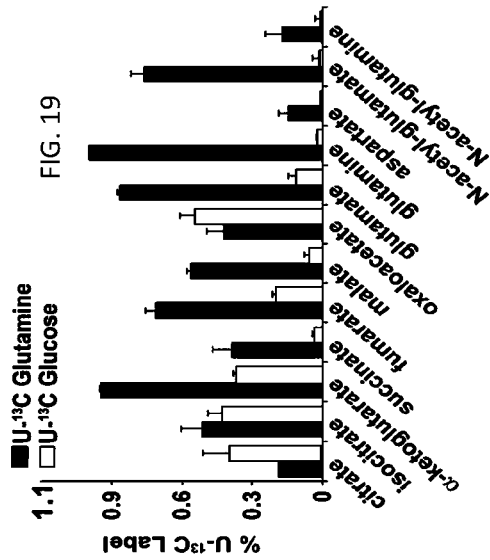
FIG. 21 is a bar graph quantifying the fold change of metabolites (G6P, F6P, GlcN6P, GlcNAc-1P and UDP-GlcNAc) in the HBP upon doxycycline withdrawal for 24 hours in iKras p53L/+ cells (iKras-1 and iKRas-2) relative to constitutive LSL-KrasG12D p53L/+ control cells (LSL-Kras); statistical significance is indicated as follows: *: $p<0.05$; **: $p<0.01$.
Figure 20:
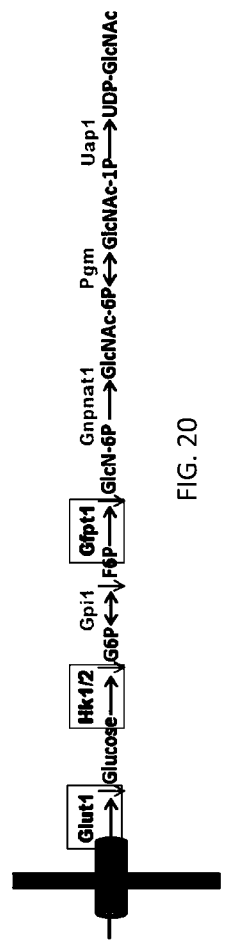
FIG. 20 is a schematic diagram summarizing the changes in the HBP upon KrasG12 inactivation. Metabolites that decrease upon doxycycline withdrawal (Glucose, G6P, F6P, GlcN6P) are indicated with downward arrows; differentially expressed genes upon doxycycline withdrawal are boxed.
Figure 24:
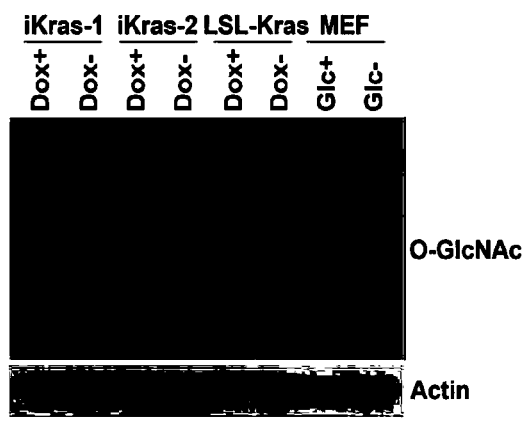
FIG. 24 is a photograph of a Western blot analysis for O-linked N-acetylglucosamine (O-GlcNAc) levels in iKras p53L/+ cells (iKras-1 and iKRas-2) and constitutive LSL-KrasG12D p53L/+ control cells (LSL-Kras) maintained in the presence or absence of doxycycline (Dox+ and Dox−, respectively) for 24 hours. For control samples, MEFs were cultured in the presence or absence of glucose (Glc+, Glc−) for 24 hours. Actin was used as a loading control.

Since $Kras^{G12D}$-regulated glycolysis metabolites, including G6P and F6P, are precursors for other glucose utilizing pathways, namely the hexosamine biosynthesis pathway (HBP) and pentose phosphate pathway (PPP), these pathways were carefully audited immediately following $Kras^{G12D}$ inactivation. Steady-state metabolite profiling showed a significant decrease in glucosamine-6-phosphate (GlcN6P), the product of the committed reaction upon entry into HBP (FIGS. 20 and 21). Correspondingly, downregulation of the rate limiting enzyme, Gfpt1, was documented at the transcriptional and protein levels (FIGS. 22A and 22B). Moreover, the HBP provides the substrate for O- and N-linked glycosylation, which supported the GSEA showing downregulation of O-glycosylation and glycan structure biosynthesis pathways (FIGS. 11 and 23) as well as decrease in the levels of total O-linked N-acetylglusamine (O-Glc-NAc) post-translational modification (FIG. 24). This profile of reduced glycosylation is comparable to that observed upon glucose starvation (FIG. 24) and strongly indicates that oncogenic $Kras^{G12D}$ is essential for the maintenance of protein glycosylation levels in established tumors.

Figure 25:
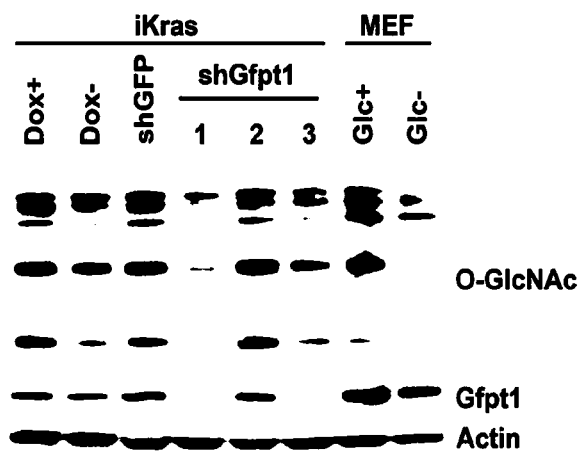
FIG. 25 is a photograph of a Western blot analysis for O-GlcNAc and Gfpt1 levels in KrasG12D p53L/+ cells infected with shRNA against GFP or Gfpt1. For control samples, MEFs were cultured in the presence or absence of glucose (Glc+, Glc−) for 24 hours. Actin was used as a loading control.
Figure 26:
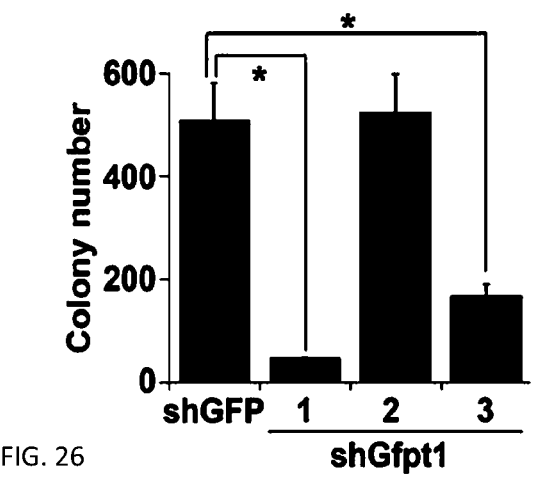
FIG. 26 is a bar graph quantifying the colony number in a soft-agar colony formation assay for iKras p53L/+ PDAC cells infected with shRNA against GFP or Gfpt1.
Figure 27:
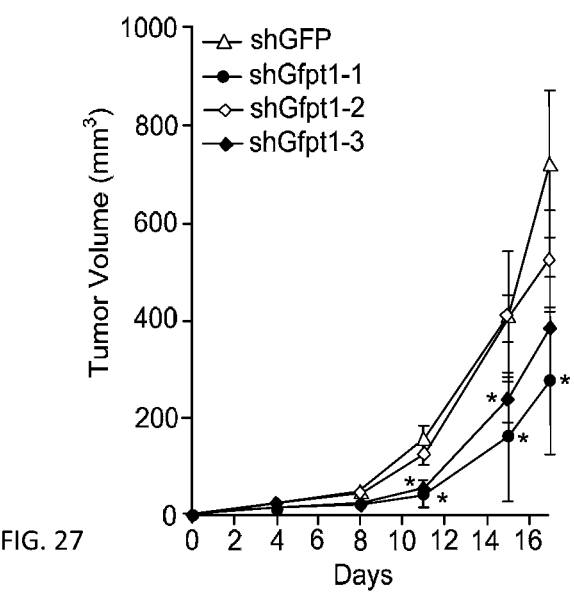
FIG. 27 is a line graph quantifying the total tumor volume (mm$^3$) in iKras p53L/+ cell lines infected with shRNA against GFP or Gfpt1 (1, 2 or 3) and subcutaneously injected into nude mice at the indicated time points following injection. Data shown are representative of results from three independent cell lines; statistical significance is indicated as follows: *: $p<0.05$; **: $p<0.01$.

To further substantiate the essentiality of $Kras^{G12D}$-mediated control of protein glycosylation, the impact of shRNA-mediated knockdown of Gfpt1 was assessed. Consistent with its pivotal role in providing protein glycosylation substrates, Gfpt1 knockdown (shRNA #1 & #3) reduced the overall O-linked glycosylation to a level similar to that of tumor cells in which $Kras^{G12D}$ is extinguished, whereas a non-targeting shRNA (shRNA #2) and a shRNA against GFP (shGFP) failed to affect glycosylation (FIG. 25). Phenotypically, Gfpt1 knockdown inhibited the clonogenic and soft-agar growth of tumor cells from both the iKras$^{G12D}$ p53$^{L/+}$ and the LSL-Kras$^{G12D}$ p53$^{L/+}$ tumor cells (FIG. 26) and suppressed xenograft tumor growth in vivo (FIG. 27). Notably, tumors that emerged in the Gfpt1 knockdown group showed recovery of Gfpt1 expression, as determined by Western blot. Thus, $Kras^{G12D}$-mediated tumor maintenance is at least partially dependent upon its stimulation of the HBP and associated protein glycosylation.

Example 6: KrasG12D in the Non-Oxidative Arm of the Pentose Phosphate Pathway

This example demonstrates that $Kras^{G12D}$ promotes ribose biogenesis through the non-oxidative arm of the pentose phosphate pathway (PPP).

Figure 28:
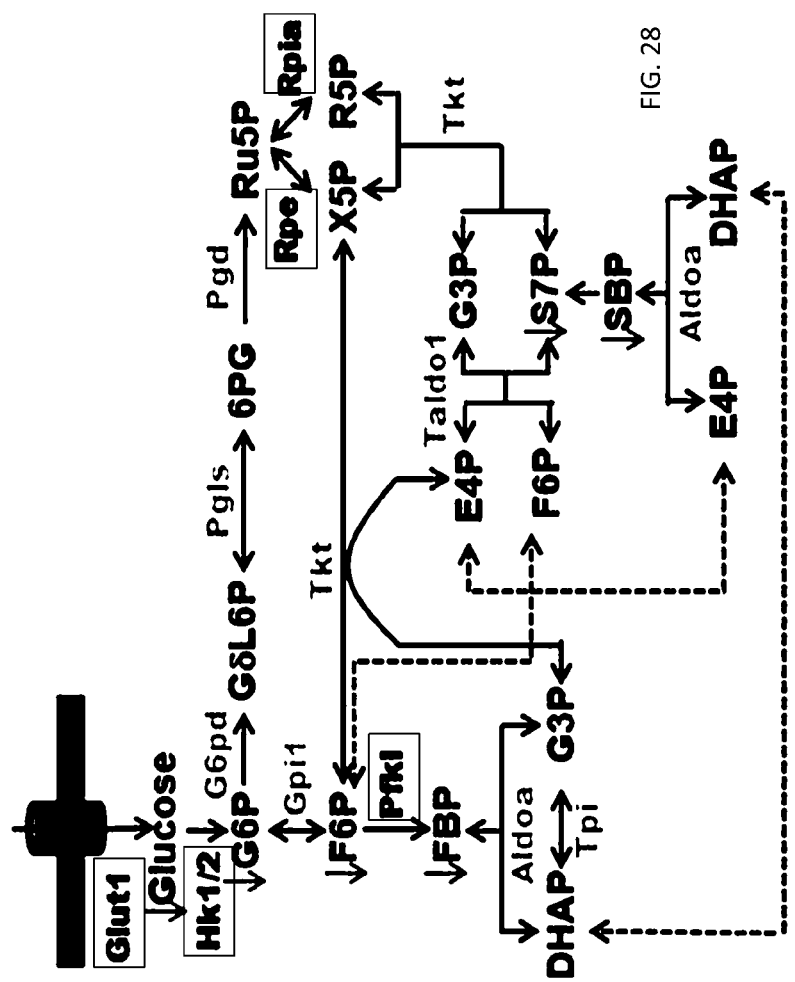
FIG. 28 is a diagram summarizing the changes in the PPP (pentose phosphate pathway) upon Kras$^{G12D}$ inactivation. Metabolites that decreased upon doxycycline withdrawal are indicated with downward arrows. Differentially expressed genes upon doxycycline withdrawal are boxed.
Figure 29:
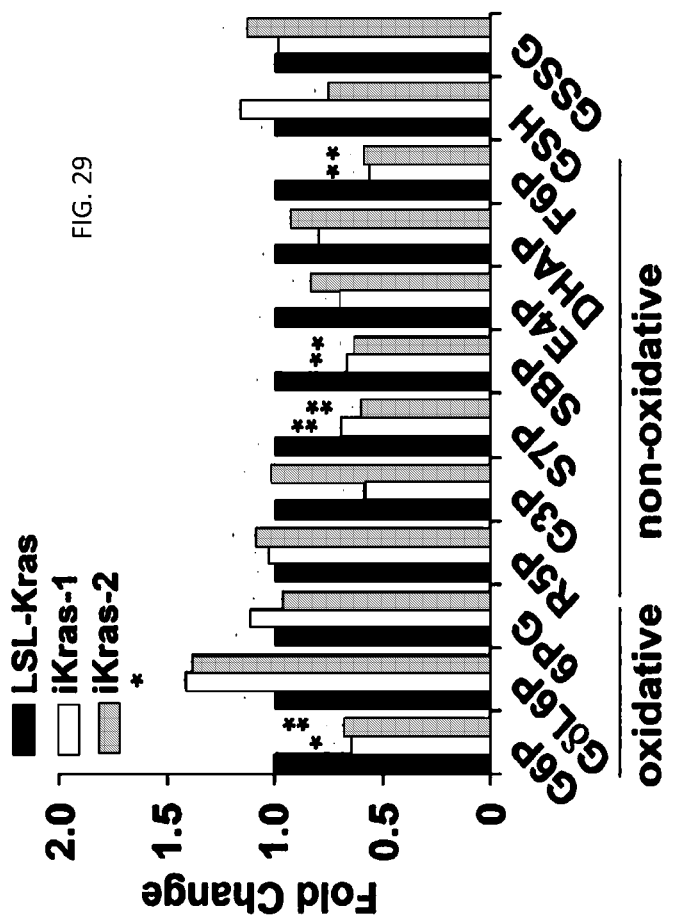
FIG. 29 is a bar graph quantifying the fold change for metabolites in the PPP (G6P, GδL6P, 6PG, R5P, G3P, S7P, SBP, E4P, DHAP, F6P, GSH, and GSSG) in iKras p53L/+ PDAC tumor cells (iKras-1 and iKras-2) relative to constitutive LSL-KrasG12D p53L/+ control cells (LSL-Kras) upon doxycycline withdrawal for 24 hours. The figure indicates whether the metabolites are associated with the oxidative or non-oxidative arm of the PPP.
Figure 30:
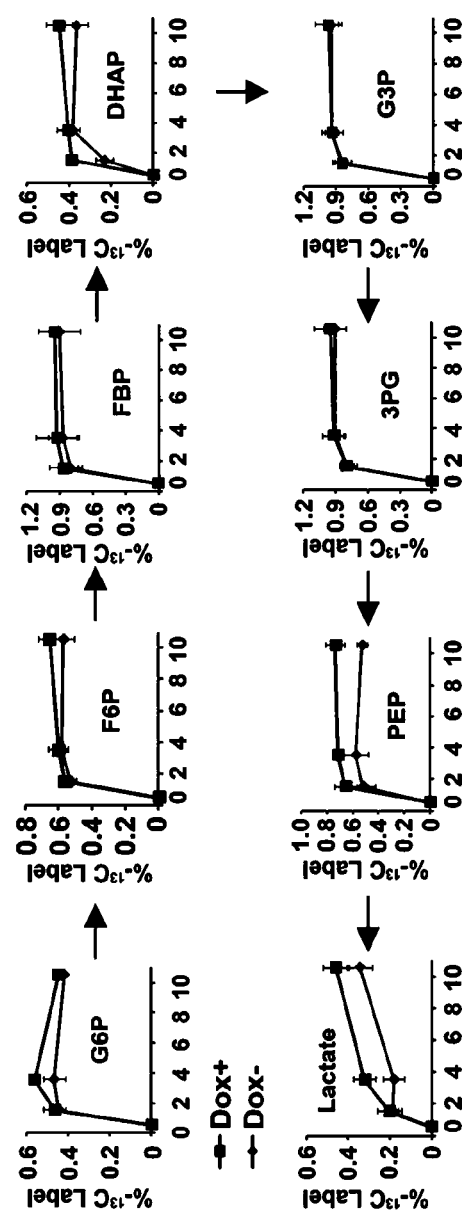
FIG. 30 is a series of bar graphs quantifying the percentage (%) of uniformly U-$^{13}$C-isotope-labeled metabolites (G6P, F6P, FBP, DHAP, Lactate, PEP, 3PG, G3P) per total metabolite pool in iKras p53L/+ PDAC cells cultured in the presence of U-$^{13}$C glucose with or without doxycycline for 24 h (Dox+, Dox−).
Figure 31:
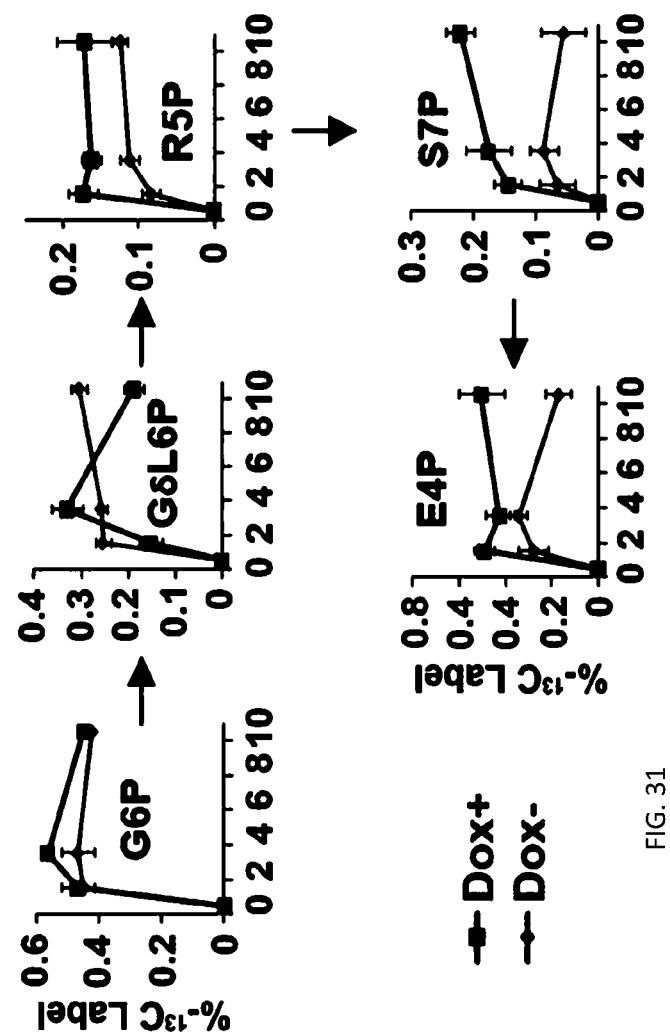
FIG. 31 is a series of bar graphs quantifying the percentage (%) of uniformly U-$^{13}$C-isotope-labeled PPP metabolites (G6P, GδL6P, E4P, S7P) per total metabolite pool in iKras p53L/+ PDAC cells cultured in the presence of U-$^{13}$C glucose with or without doxycycline for 24 h (Dox+, Dox−).

The PPP utilizes glucose to generate the ribose ring of DNA and RNA and to maintain cellular reducing power in the form of NADPH. Metabolomic profiling analysis revealed significant changes in several metabolites from the PPP (FIG. 28). In particular, steady state metabolomic analysis showed that an intermediate unique to the PPP, sedohepulose-7-phosphate (S7P), was significantly reduced upon $Kras^{G12D}$ extinction (FIG. 29). To further elucidate the effect of $Kras^{G12D}$ activity on glucose catabolism through the PPP, U-$^{13}C_6$-glucose was used to trace glucose flux into the PPP. Consistent with the steady state metabolite data, it was observed that $Kras^{G12D}$ maintains glycolysis without affecting the TCA cycle. The flux of U-$^{13}C_6$-glucose into the TCA cycle intermediates, citrate, fumarate and oxaloacetic acid (OAA) was not altered upon doxycycline withdrawal, whereas decreased flux into the glycolytic metabolites, phosphoenolpyruvic acid (PEP) and lactate were observed (FIG. 30). Moreover, we observed a dramatic reduction in flux of U-$^{13}C_6$-glucose into ribose-5-phosphate (R5P), S7P and erythose-4-phosphate (E4P), components which are unique to the non-oxidative arm of the PPP (FIG. 31). This was especially striking given that changes in flux through the oxidative arm of the PPP were not observed (FIG. 31), nor were significant changes evident by steady state profiling (FIG. 29). Given the unprecedented link between oncogenic Kras signaling and the non-oxidative arm of the PPP, it was next sought to further compare and quantify flux through the two arms (oxidative and non-oxidative) of the PPP.

Figure 32:
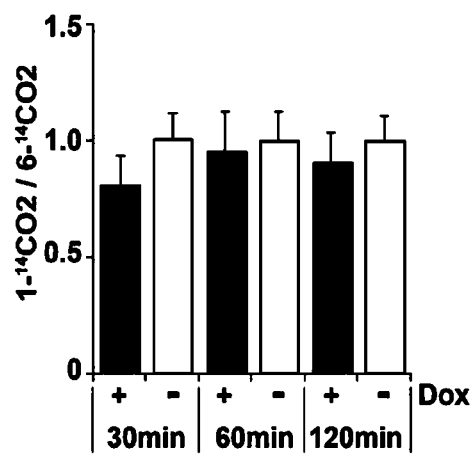
FIG. 32 is a bar graph quantifying the amount of $^{14}$C-labeled $CO_2$ released at the indicated time points from cultured iKras p53L/+ PDAC cells maintained in the presence or absence of doxycycline for 24 hours (+/−Dox), at which point 1-$^{14}$C or 6-$^{14}$C glucose was introduced into the media. $CO_2$ derived from 1-$^{14}$C glucose can be generated from either oxidative PPP or TCA cycle flux, whereas $CO_2$ derived from 6-$^{14}$C glucose can be generated only from TCA cycle flux. Data are normalized to 6-$^{14}$C glucose to account for potential iKras-mediated changes in glucose-derived TCA flux.
Figure 33:
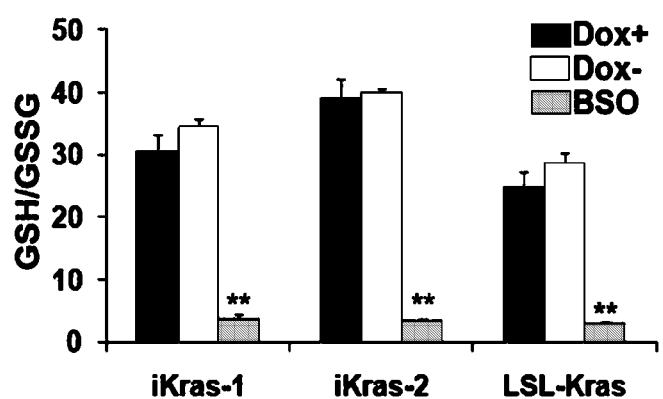
FIG. 33 is a bar graph quantifying the GSH and GSSG levels normalized to cell number in iKras p53L/+ cells or constitutive LSL-KrasG12D p53L/+ control cells (LSL-Kras) maintained in the presence or absence of doxycycline (Dox+/−) or treated with 0.5 mM BSO for 24 hours; statistical significance is indicated as follows: *: p<0.05.

Previously, it has been suggested that the oxidative and non-oxidative arms of the PPP can be decoupled in order to facilitate ribose biosynthesis without affecting the cellular redox potential (NADP+/NADPH ratio). To explore this possibility in the context of $Kras^{G12D}$-driven PDAC, $^{14}C_1$- or $^{14}C_6$-labeled glucose was used to measure the production of $CO_2$ from the oxidative PPP ($^{14}C_1$—$CO_2$) relative to that generated from the glycolysis-TCA cycle route ($^{14}C_6$—$CO_2$). Consistent with data showing that $Kras^{G12D}$ deinduction exerts a minimal effect on TCA cycle intermediates (FIG. 18), no obvious change in the release of $^{14}C_6$—$CO_2$ was observed upon doxycycline withdrawal (FIG. 32). More importantly, no significant decrease in the release of $^{14}C_1$—$CO_2$ was detected (FIG. 32), indicating $Kras^{G12D}$ extinction was not associated with decreased flux through the oxidative arm of the PPP. In addition, cellular reduced glutathione (GSH) and oxidized glutathione (GSSG) levels, which are regulated by NADPH production, were not significantly altered by $Kras^{G12D}$ inactivation, as measured by both metabolomic profiling and biochemical analysis (FIGS. 29 and 33). In contrast, buthionine sulfoximine (BSO) treatment, which depletes intra-cellular GSH, dramatically reduced the ratio of GSH/GSSG (FIG. 33). These results provided strong evidence supporting the observation that $Kras^{G12D}$ does not mediate the oxidative arm of the PPP.

Figure 34A:
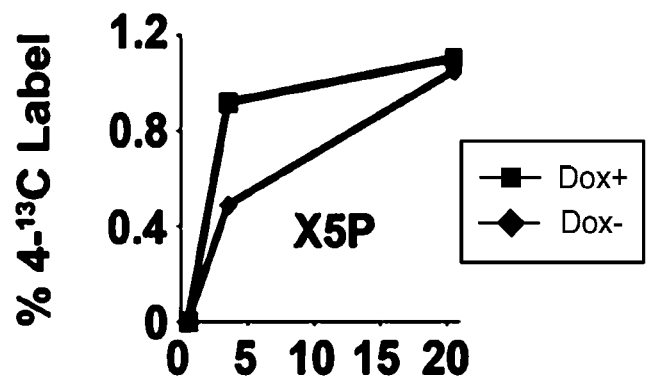
FIGS. 34A and 34B are bar graphs quantifying 1,2-$^{13}$C glucose labeling kinetics for 4-$^{13}$C-labeled X5P (FIG. 34A) or 2-$^{13}$C-labeled S7P (FIG. 34B), expressed as percentages (%) of $^{13}$C-labeled metabolite per total metabolite pool, at 3 and 20 minutes in iKras p53L/+ cells maintained in the presence ("Dox+") or absence ("Dox−") of doxycycline for 24 hours.
Figure 34B:
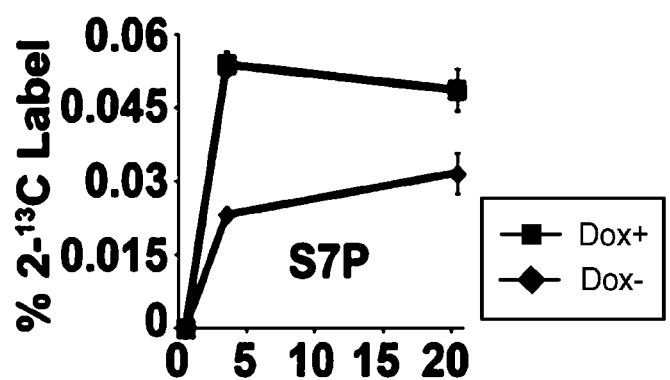

To further corroborate the specific regulation of non-oxidative PPP by $Kras^{G12D}$, the incorporation of individual glucose carbons were traced using 1,2-$^{13}C$-glucose. As shown in FIGS. 34A and 34B, $Kras^{G12D}$ extinction leads to a rapid decrease in 2-$^{13}C$-labeled S7P and 4-$^{13}C$-labeled X5P, labeling patterns which can only occur if these molecules are generated via the non-oxidative PPP. Interestingly, a significant decrease of sedoheptulose 1,7-bisphosphate (SBP) was also observed upon $Kras^{G12D}$ inactivation (FIG. 29). SBP was recently shown to be a unique metabolite in the non-oxidative PPP, whose hydrolysis to S7P provides the thermodynamic driving force to propel ribose biogenesis without engaging the oxidative arm. The downregulation of SBP upon oncogene extinction implies that $Kras^{G12D}$ may utilize this mechanism to facilitate flux through the non-oxidative arm of the PPP.

Figure 35:
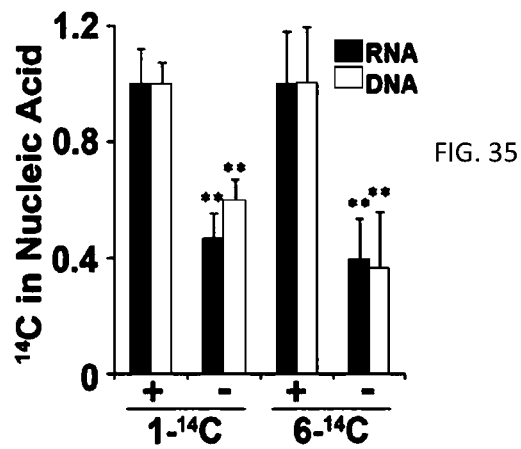
FIG. 35 is a bar graph quantifying the incorporation of radioactivity into DNA or RNA normalized to DNA or RNA concentration. iKras p53$^{L/+}$ cells maintained in the presence or absence of doxycycline (+/−) for 24 hours, followed by a 24 hour labeling with 1-$^{14}$C or 6-$^{14}$Cglucose. 6-$^{14}$C glucose can give rise to radioactively-labeled R5P (and subsequently DNA or RNA) from either the oxidative or the non-oxidative PPP. 1-$^{14}$C glucose, on the other hand, can only give rise to radioactively-labeled R5P via the non-oxidative arm of the PPP; statistical significance is indicated as follows: **: p<0.01.

The primary role of the non-oxidative arm of the PPP is to generate ribose-5-phosphate (R5P). Equally important reactions also include the recycling of pentose into hexoses and trioses which can be utilized in glycolysis. As such, it was hypothesized that the differential flux of glucose into the non-oxidative arm of the PPP by $Kras^{G12D}$ occurs in order to provide tumor cells with sufficient R5P for DNA and RNA biosynthesis. To explore this possibility, $^{14}C_1$- or $^{14}C_6$-labeled glucose were used to track the contribution of oxidative versus non-oxidative PPP into DNA and RNA. Whereas $^{14}C_6$-labeled glucose will give rise to radioactive DNA/RNA whether it is used by the oxidative or the non-oxidative arm of the PPP $^{14}C_1$-labeled glucose will only give rise to radioactive DNA/RNA if it is used by the non-oxidative arm (the $^{14}C_1$ label is lost as $CO_2$ through the oxidative arm; FIG. 32). As shown in FIG. 35, $Kras^{G12D}$ extinction led to a dramatic drop in the incorporation of both $^{14}C_1$- and labeled glucose into DNA/RNA, clearly demonstrating a predominant and $Kras^{G12D}$-mediated role for the non-oxidative arm of the PPP in R5P biogenesis. These data reveal a novel role for $Kras^{G12D}$ in preferential maintenance of glycolytic flux through the non-oxidative arm of the PPP in established PDAC tumors.

Example 7: Suppression of $Kras^{G12D}$-Dependent Tumorigenesis

This example demonstrates that inhibition of the non-oxidative PPP suppresses $Kras^{G12D}$-dependent tumorigenesis.

Figure 36:
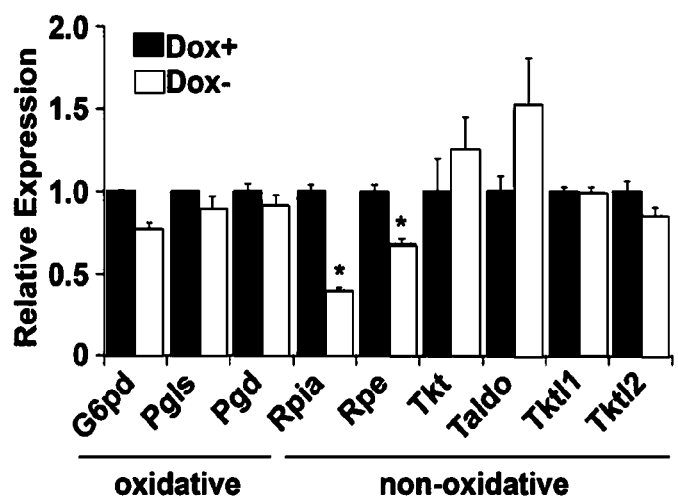
FIG. 36 is a bar graph quantifying the relative mRNA levels of PPP genes (G6pd, Pgls, Pgd, RPIA, RPE, Tkt, Taldo, Tkt11, Tkt12) in iKras p53L/+ cells cultured in the presence or absence of doxycycline (Dox+/Dox−) for 24 hours.
Figure 37A:
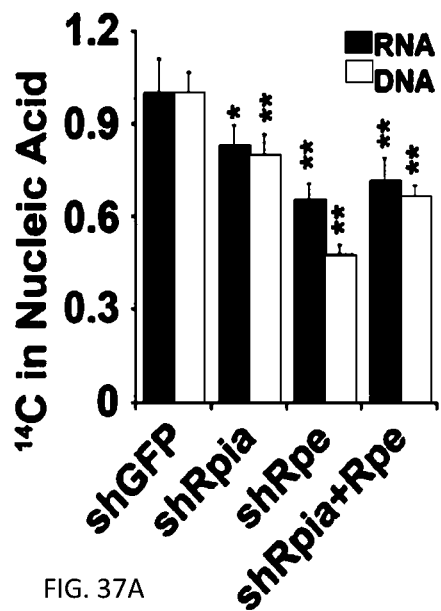
FIG. 37A is a bar graph quantifying the incorporation of radioactivity into DNA or RNA normalized to DNA or RNA concentration in iKras p53L/+ cells maintained in the presence or absence of doxycycline (+/−) for 24 hours, infected with shRNA against RPIA and RPE individually or in combination, followed by a 24 hour labeling with 1-$^{14}$C or 6-$^{14}$Cglucose. shRNA against GFP was used as a control.
Figure 37B:
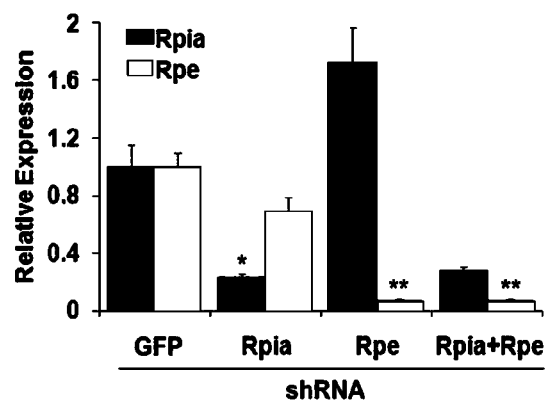
FIG. 37B is a bar graph quantifying the relative expression of RPIA and RPE in iKras p53$^{L/+}$ PDAC cells infected with shRNA against GFP, RPIA or RPE, or RPIA+RPE; statistical significance is indicated as follows *: p<0.05; **: p<0.01.
Figure 38:
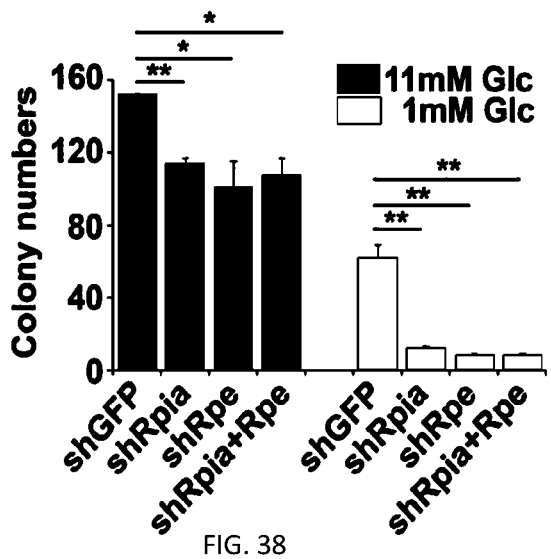
FIG. 38 is a bar graph quantifying the clonogenic activity, expressed as colony number, in iKras p53L/+ cells maintained under high (11 mM) or low (1 mM) glucose, determined for cells infected with shRNA against GFP, RPIA, RPE, or RPIA+RPE; statistical significance is indicated as follows: *: p<0.05; **: p<0.01.
Figure 39:
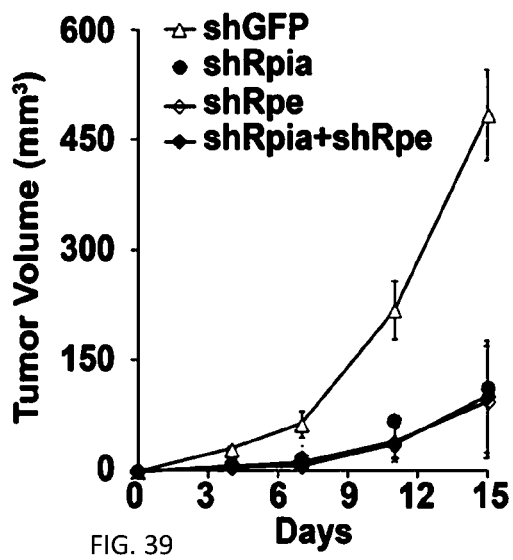
FIG. 39 is a line graph quantifying tumor volumes at the indicated time points following subcutaneous injection of iKras p53L/+ cells infected with shRNA against GFP, RPIA, RPE, or RPIA+RPE into nude mice.

In agreement with the specific regulation of the non-oxidative arm of the PPP, the enzymes involved in the oxidative arm, including G6pd, Pgls and Pgd, as well as the enzymatic activity of G6pd, the rate limiting step for the oxidative arm of the PPP, are not altered upon $Kras^{G12D}$ extinction (FIG. 36). In contrast, the expression levels of RPIA and RPE, enzymes that regulate carbon exchange reactions in the non-oxidative arm of the PPP, are significantly decreased (FIG. 36). In agreement with their roles in the non-oxidative PPP, knockdown of either RPIA or RPE, or in combination, significantly reduced the flux of $^{14}C_1$-labeled glucose into DNA and RNA (FIGS. 37A and 37B), indicating that the selective regulation of non-oxidative phase by oncogenic Kras is, at least, partially mediated through the down-regulation of RPIA and RPE. More importantly, while RPIA or RPE knockdown moderately suppresses the clonogenic activity of iKras $p53^{L/+}$ tumor cells in high-glucose (11 mM), the inhibitory effect is dramatically enhanced when cells were switched to low-glucose containing media (1 mM) (FIG. 38), a condition which may reflect the decreased glucose uptake and glycolytic flux after $Kras^{G12D}$ extinction. These findings were corroborated with the decrease in xenograft tumor growth upon RPIA or RPE knockdown (FIG. 39), further supporting the functional importance of the non-oxidative PPP during $Kras^{G12D}$-mediated PDAC maintenance.

Figure 41:
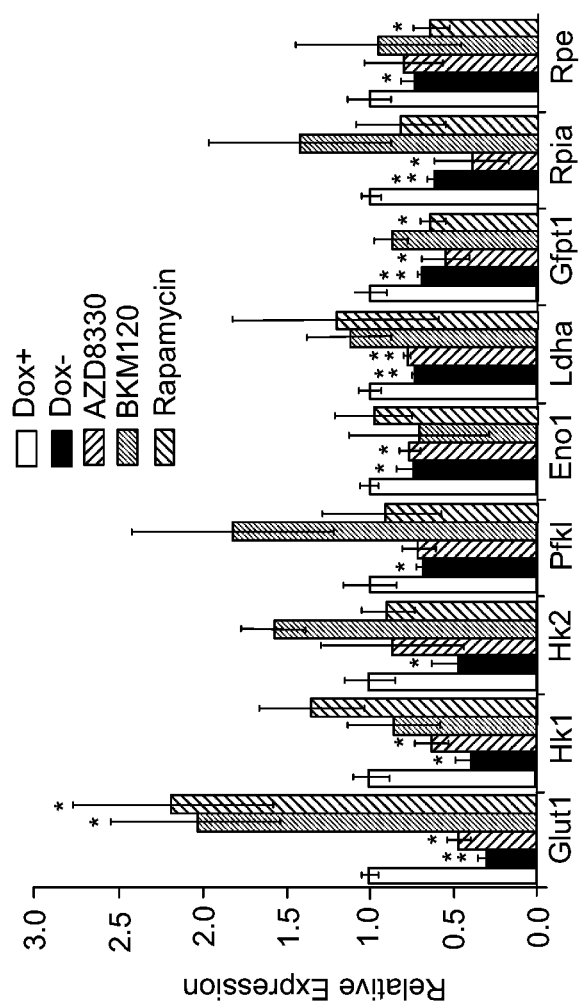
FIG. 41 is a bar graph showing the relative mRNA expression of the indicated genes in iKras p53L/+ cells treated with MEK inhibitor, AZD8330 (50 nM), BKM120 (150 nM), or Rapamycin (20 nM) for 18 hours. Error bars represent SD of the mean; *p<0.05; **p<0.01.
Figure 42:
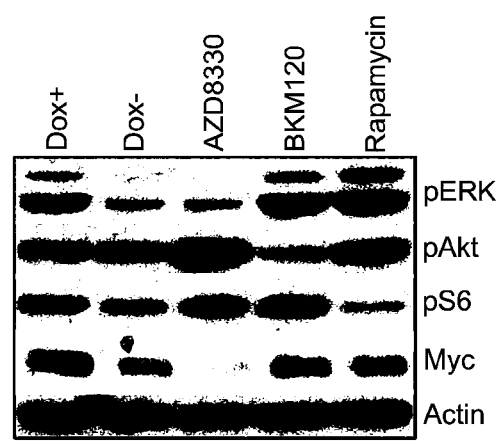
FIG. 42 is a photograph of a Western blot showing expression of phospho-Akt, phospho-Erk, phospho-S6, Myc, and Actin (loading control) in iKras p53L/+ cells treated with AZD8330 (50 nM), BKM120 (150 nM), or Rapamycin (20 nM) for 18 hours. As control, cells were cultured in the presence or absence of doxycycline for 24 hours.
Figure 43:
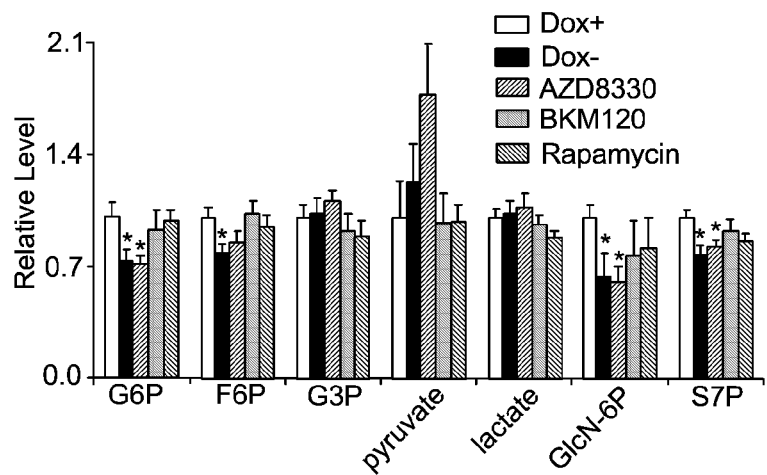
FIG. 43 is a bar graph showing the relative steady-state levels of the indicated metabolites measured by targeted LC-MS/MS, in iKras p53L/+ cells treated with AZD8330 (50 nM), BKM120 (150 nM), or Rapamycin (20 nM) for 18 hours. As control, cells were cultured in the presence or absence of doxycycline for 24 hours. Error bars represent SD of the mean. *p<0.05; **p<0.01.
Figure 44:
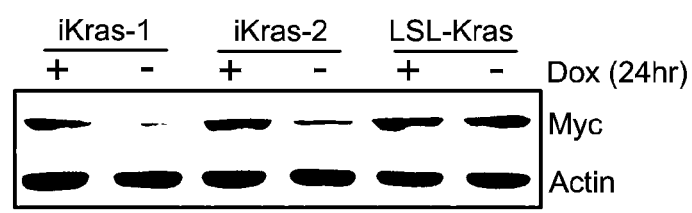
FIG. 44 is a photograph of a Western blot showing expression of Myc and Actin (loading control) in cell lysates of iKras p53L/+ or LSL-KrasG12D p53L/+ PDAC cell lines cultured in the presence or absence of doxycycline for 24 hours.
Figure 45:
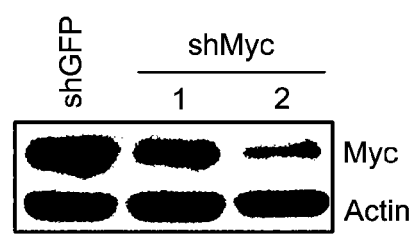
FIG. 45 is a photograph of a Western blot showing expression of Myc and Actin (loading control), following shRNA knockdown of Myc (using shMyc-1 or shMyc-2) in iKras PDAC cells (shGFP was used as control shRNA).
Figure 46:
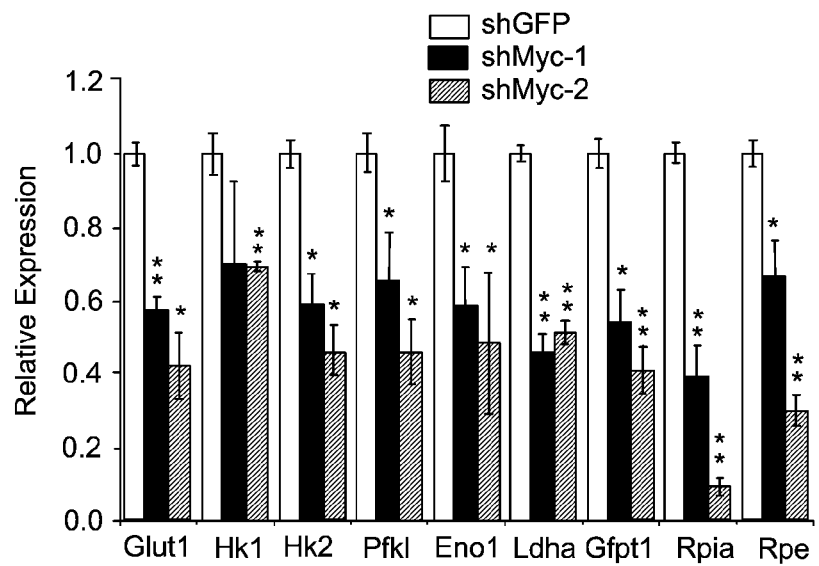
FIG. 46 is a bar graph showing relative mRNA expression of the indicated genes following shRNA knockdown of Myc (using shMyc-1 or shMyc-2) in iKras PDAC cells (shGFP was used as control shRNA); *p<0.05; **p<0.01.

Example 8: Inhibition of the Nonoxidative PPP Suppresses $Kras^{G12D}$-Dependent Tumorigenesis To further dissect the downstream mechanism of $Kras^{G12D}$-mediated metabolic reprogramming, specific pharmacological inhibitors were used to examine the impact of effector pathways on tumor metabolism. iKras p53L/+ cells were treated with AZD8330 (50 nM), BKM120 (150 nM), or Rapamycin (20 nM) for 18 hr. In parallel, cells were cultured in the presence or absence of doxy for 24 hr to serve as controls and relative mRNA levels of indicated metabolism genes were measured by QPCR. Some cell lysates were blotted for phospho-Akt, phospho-Erk, phospho-S6, and Myc. As shown in FIG. 41, the expression of several glycolytic genes (Glut1, Hk1, Eno1, Ldha), the rate-limiting HBP gene (Gfpt1), as well as a nonoxidative PPP gene (Rpia) were significantly decreased by MEK inhibition, using AZD8330, at a dose that exerts a similar effect on ERK phosphorylation as that observed upon doxy withdrawal (FIG. 42). Consistently, MAPK inhibition recapitulated the $Kras^{G12D}$ inactivation induced metabolite changes in the glycolysis, HBP and nonoxidative PPP pathways (FIG. 43). These data indicated that the MAPK pathway is a major effector of oncogenic Kras-mediated glucose metabolism remodeling in PDAC, which is consistent with the rapid decrease of MAPK signaling upon oncogene inactivation (FIGS. 7 and 8). In contrast, although mTOR signaling is also suppressed upon $Kras^{G12D}$ inactivation, rapamycin treatment did not induce extensive changes in glucose metabolism. In agreement with the minimal alteration in Akt signaling upon oncogene silencing (FIGS. 7 and 8), inhibition of PI3K-AKT signaling, using BKM120, did not exhibit a significant impact on iKras-directed tumor metabolism (FIGS. 41, 42 and 43). To gain further insight into the $Kras^{G12D}$-mediated transcriptional regulation that facilitates metabolic reprogramming, promoter analysis was performed on differentially expressed genes upon $Kras^{G12D}$ inactivation. In silico cis-element analysis revealed a highly significant enrichment of the Myc binding element ($p=5.11 \times 10^{-65}$). Furthermore, Myc protein level was decreased upon $Kras^{G12D}$ inactivation or MEK inhibitor treatment (FIGS. 41 and 44). Because it has been shown that Myc is required for Ras-dependent tumor maintenance, the above data indicate that Myc may be a prominent mediator of the $Kras^{G12D}$-dependent transcriptional regulation of metabolism genes. Indeed, shRNA knockdown of Myc in iKras PDAC cells significantly downregulated the expression of metabolism genes in the glycolysis, HBP, and nonoxidative PPP pathways (FIGS. 45 and 46).

Another possible candidate mediator of Kras-induced transcriptional changes of metabolism genes was HIF1a. Although there was some enrichment of HIF1a promoter elements in the Kras transcriptional changes, knockdown of HIF1a had only minimal impact on metabolic enzyme expression. Together, the data indicated that the MAPK pathway and Myc-directed transcriptional control play key roles for $Kras^{G12D}$-mediated metabolic reprogramming in PDAC.

Figure 48:
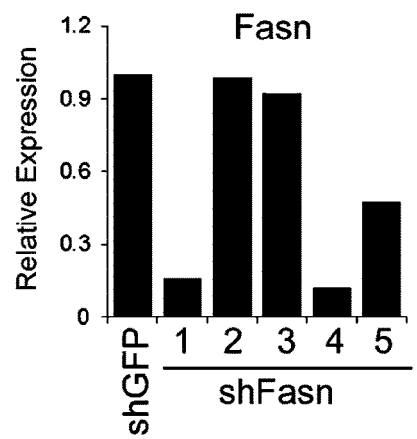
FIG. 48 is a bar graph quantifying the relative expression level of FASN in iKras p53L/+ PDAC infected with shRNA against GFP or FASN.
Figure 49:
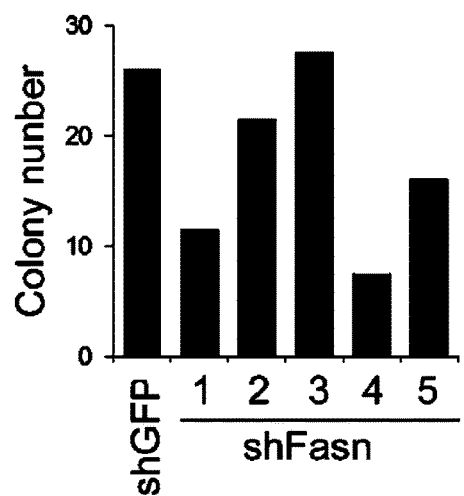
FIG. 49 is a bar graph quantifying the colony numbers in a clonogenic assay for iKras p53L/+ PDAC cells infected with shRNA against GFP or FASN.

Example 9: FASN is Important for Tumorigenic Activity of iKras p53L/+ PDAC Cells As shown in Example 4, above, extinction of iKras led to decreased expression of FASN. Thus, it was next determined whether FASN plays a role in tumorigenesis in PDAC tumor model. iKras p53L/+ PDAC were treated with shRNA against FASN or GFP (control). As shown in FIG. 48, FASN shRNA1 and shRNA4, and to some extent shRNA5, caused a marked decrease in FASN expression in PDAC. As shown in FIG. 49, FASN shRNA1 and shRNA4, and to some extent shRNA5, also induced a marked decrease in colony formation. Thus, FASN was determined to play a role in tumorigenic activity of iKras p53L/+ PDAC cells.

Discussion

Figure 40:
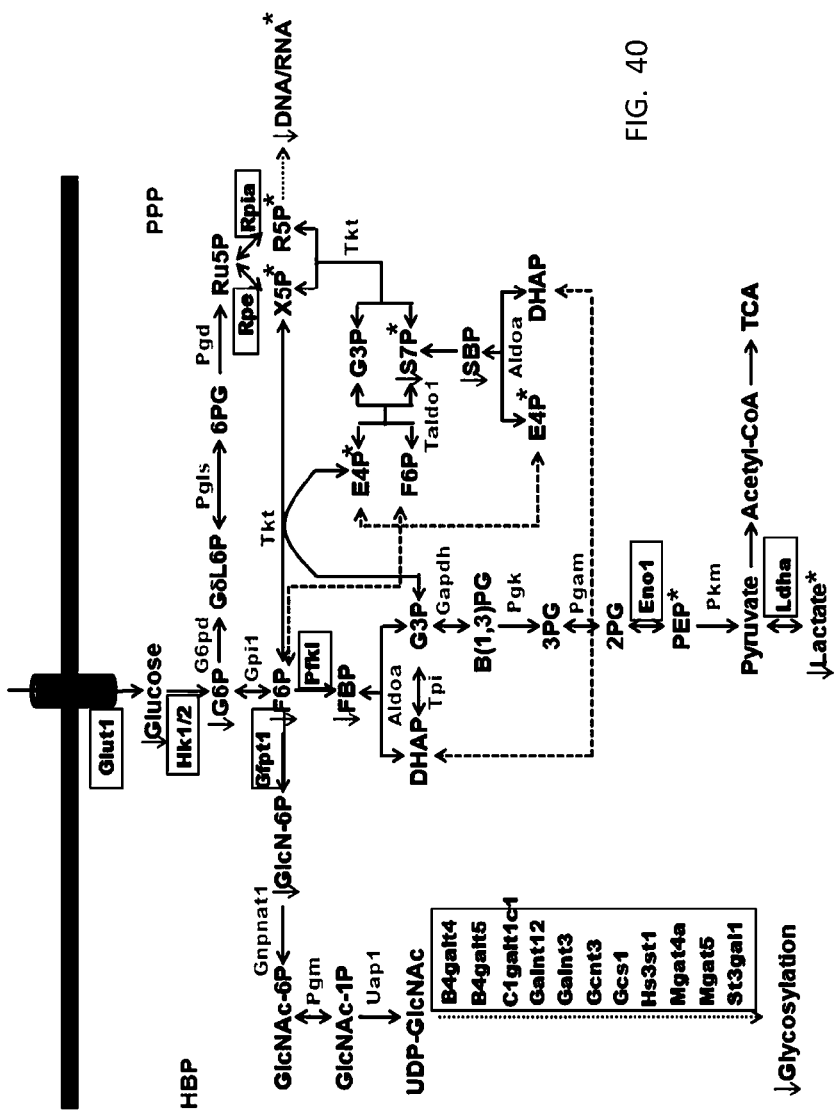
FIG. 40 is a diagram summarizing the changes in glucose metabolism upon KrasG$^{12D}$ inactivation. Metabolites or pathways that decreased upon doxycycline withdrawal are indicated with downward arrows. Asterisks indicate metabolites that showed a decrease in flux in isotope labeled glucose experiments. Metabolic enzymes whose expression decreased upon doxycycline withdrawal are boxed.

In the present Examples, a novel inducible $Kras^{G12D}$-driven PDAC model provided genetic evidence that oncogenic Kras serves a tumor maintenance role in fully established PDAC. Integrated genomic, biochemical and metabolomic analyses immediately following $Kras^{G12D}$ extinction revealed a prominent perturbation of multiple metabolic pathways. These finding are summarized in FIG. 40. In particular, $Kras^{G12D}$ exerts potent control of glycolysis through regulation of glucose transporter and several rate-limiting enzymes at the transcriptional level and serves to shunt glucose metabolism towards anabolic pathways, such as HBP for protein glycosylation and PPP for ribose production. Notably, a novel connection between oncogenic Kras and the non-oxidative arm of the PPP, which functions to provide precursors for DNA and RNA biosynthesis, was identified. This characterization of $Kras^{G12D}$-mediated metabolic reprogramming, coupled with functional validation of several $Kras^{G12D}$-regulated metabolic enzymes, provided candidate therapeutic targets and associated biomarkers for this key cancer pathway in this intractable disease.

$Kras^{G12D}$ is Required for PDAC Maintenance

Studies in multiple GEM models have shown that tumor maintenance at advanced stages is often dependent on the driver oncogene which initiates tumor development. However, recent in vitro studies in human PDAC cell lines have indicated that certain pancreatic cell lines expressing mutant Kras may lose dependence on this oncogene, raising the question as to whether oncogenic Kras remains relevant to tumor maintenance in advanced PDAC in the in vivo setting. In the present Examples, the observation of complete regression of fully established tumors approximately one week upon $Kras^{G12D}$ extinction underscored the essential role of this signature oncogene in this disease. It is also worth noting that, during tumor maintenance, oncogenes can operate in a context-dependent manner as evidenced by the previously reported capacity of p53 deficiency to impact on tumor regression in Wnt-induced mouse breast cancers.

Oncogenic Kras$^{G12D}$ Directs Glucose Metabolism to Biosynthetic Pathways in PDAC The reprogramming of cellular metabolism to support continuous proliferation is a hallmark of cancer. Such alterations in metabolic programs may be a direct consequence of oncogene activation or simply adaptive responses to the proliferative effect of driver oncogenes. As demonstrated herein, the serial analysis in vivo following Kras$^{G12D}$ extinction showed rapid downregulation of specific metabolic enzymes and their pathways prior to any discernable biological impact (e.g., morphological or proliferative changes), a finding consistent with the active control of tumor cell metabolism by Kras$^{G12D}$. The recent finding that glucose deprivation drives the acquisition of oncogenic Kras$^{G12D}$ mutation in tumor cells further underscores the intimate link between Kras$^{G12D}$ and metabolic adaptation in tumor cells. Indeed, the Kras oncogene is well known to induce aerobic glycolysis. Correspondingly, the present disclosure establishes that Kras$^{G12D}$ extinction leads to significant inhibition of glucose uptake and a decrease in glycolytic intermediates such as G6P, F6P and FBP. Moreover, p53 loss in the iKras model may also contribute to the increased glycolysis through phosphfructokinase activation due to loss of expression of the p53 downstream target TIGAR. Although aerobic glycolysis is recognized as inefficient from a bioenergetics perspective, such metabolic reprogramming has been proposed to serve as a mechanism which allows the allocation of glycolytic intermediates into biosynthetic pathways. Such hypotheses are further supported by the observation that amplification/overexpression of PHGDH, a rate-limiting enzyme functioning to divert 3-phosphoglycerate (a glycolytic intermediate) into the serine biosynthesis pathway, facilitates tumor growth in certain contexts. Furthermore, in line with recent findings that oncogenes such as c-Myc and Kras drive the utilization of glutamine as an alternative carbon source to fuel the TCA cycle, the present Examples also demonstrate that the glutamine carbon backbone is the primary anabolic contributor to TCA cycle intermediates in PDAC cells.

The activation of Hexosamine Biosynthesis and Glycosylation Pathways by Kras$^{G12D}$ It is presently discovered that oncogenic Kras plays a prominent role in the flux of glucose into the HBP. The data in the present Examples show that the expression of Gfpt1, the first and rate-limiting step of HBP, is strongly downregulated upon Kras$^{G12D}$ inactivation. In addition, the decrease in F6P, the substrate for Gfpt1, due to the inhibition of glucose uptake and subsequent glycolysis steps may also contribute to the downregulation of glucoseamine-6-phosphate. The HBP is obligatory for various glycosylation processes, such as protein N- or O-glycosylation and glycolipid synthesis. Although its function during tumorigenesis is poorly understood, recent studies indicate that the HBP is important for coordination of nutrient uptake, partially through modulating the glycosylation and membrane localization of growth factor receptors. Protein and lipid glycosylation is the most abundant posttranslational modification and plays fundamental regulatory roles in tumor cell proliferation, invasion/metastasis, angiogenesis and immune evasion. Ras oncogenes have been previously reported to induce N-glycosylation, and Kras mutation in human colorectal cancer cells is associated with increased N-linked carbohydrate branching. Here, additional evidence is provided that oncogenic Kras signaling also sustains protein O-glycosylation during tumor maintenance. The downregulation of glycosylation pathways upon Kras$^{G12D}$ extinction is likely the combined consequences of changes at multiple levels: 1) decreased precursor availability due to diminished HBP; 2) downregulation of multiple protein glycosylation enzymes; and 3) inhibition of protein synthesis due to abrogation of mTOR/S6K pathway. Multiple nuclear and cytoplasmic proteins are modified by O-glycosylation and recent studies have shown that OGT, the enzyme responsible for protein O-glycosylation is overexpressed in certain breast cancers and is important for tumorigenesis. Since protein O-glycosylation is involved in extensive crosstalk with other forms of post-translational modification, such as phosphorylation, it is conceivable that Kras oncogene finetunes the function of multiple cellular proteins through the regulation of its downstream kinase cascades and the glycosylation pathways.

Kras$^{G12D}$ Induces Non-Oxidative Pentose Phosphate Pathway Flux

The PPP is considered important for tumorigenesis as it provides NADPH for macromolecule biosynthesis and ROS detoxification, as well as ribose-5-phosphate for DNA/RNA synthesis. Additionally, it has been shown that the Ras oncogene promotes cellular resistance to oxidative stress through GSH-based ROS scavenger pathways and this is likely mediated by the production of NADPH through the oxidative arm of PPP. In fact, the oxidative arm of the PPP has been shown to be activated by Kras oncogene-mediated transformation and it has been suggested that this activation is essential for Kras-mediated cell proliferation. Notably, however, obvious changes in the oxidative PPP was not observed, while a role for oncogenic Kras signaling in the preferential maintenance of the non-oxidative arm of PPP was observed. It has been recently shown that p53 inhibits G6PD activity through direct binding. Therefore, it is possible that the oxidative PPP is largely regulated by p53 deficiency in tumor cells, while oncogenic signaling from Kras$^{G12D}$ sustains the nucleotide pool through de novo biosynthetic pathways. Although the serine biosynthesis pathway downstream of glycolysis may contribute to de novo nucleic acid synthesis, no obvious alteration in this pathway was observed upon oncogene extinction. On the other hand, the 1,2-$^{13}$C-glucose flux experiments clearly indicated that the non-oxidative arm accounts for the majority of glucose flux into the ribose subsequently used for nucleic acid biosynthesis (FIGS. 34A and 34B). Indeed, recent evidence suggests that the non-oxidative PPP is preferentially upregulated in tumor cells including pancreatic cancer. The present data indicate, for the first time, that such metabolic changes are tightly regulated by oncogenic Kras and that suppression of the non-oxidative PPP blocks tumorigenic activity. These data suggest that inhibition of the early steps of nucleotide biosynthesis, such as R5P production, can provide a useful therapeutic strategy for Kras$^{G12D}$ mutant tumors.

One interesting observation of Kras$^{G12D}$-mediated metabolic reprogramming is the significant drop of SBP upon Kras$^{G12D}$ inactivation. Interestingly, an enzyme was recently discovered in yeast that dephosphorylates SBP thereby providing the thermodynamic driving force for canonical F-type non-oxidative PPP flux independent of the oxidative arm. However, attempts at identifying a mammalian ortholog have been unsuccessful. Alternatively, SBP has also been reported to function in an alternative 'L-type' PPP in liver which eventually feeds into the non-oxidative arm. The present finding is the first connection of this pathway to a driver oncogene and may provide a unique diagnostic and therapeutic avenue for these Ras-driven tumors.

Transcription Control of Metabolism Networks by Kras Oncogene

The prominence of multiple metabolic pathways in the gene set enrichment analysis was somewhat unexpected given the more canonical roles of $Kras^{G12D}$ in diverse tumor biological processes. These striking and specific transcriptional alterations of metabolism genes, which show high concordance with the actual metabolic changes, adds to the well-established means of metabolic regulation via allosteric effects of metabolites on rate-limiting enzymes.

The present findings underscore the relevance of control of expression of key enzymes or transporters as a mechanism to achieve metabolic reprogramming in tumor cells to determine the metabolic flux route and rate.

A number of embodiments of the invention have been described. Nevertheless, it will be understood that various modifications may be made without departing from the spirit and scope of the invention. It is further to be understood that all values are approximate, and are provided for description. Accordingly, other embodiments are within the scope of the following claims.

SEQUENCE LISTING (176 sequences)

SEQ ID NO: 1 - DNA, 5376 bp, Homo sapiens
  GenBank Accession No. NM_033360
ggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagagagtggaggatgctttttatacattggtgagggagatccgacaatacagattgaaaaaaatcagcaaagaagaaaagactcctggctgtgtgaaaattaaaaaatgcattataatgtaatctgggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggtttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccgcacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaaaataaaaatagttacagtgacaaaaaaaaaaaaaaa

SEQ ID NO: 2 - DNA, 5312 bp, Homo sapiens
  GenBank Accession No. NM_004985.3
ggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggtttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccgcacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgacaaaaaaaaaaaaaaa

SEQ ID NO: 3 - protein, 189 aa, Homo sapiens [sequence omitted]

SEQ ID NO: 4 - protein, 188 aa, Homo sapiens [sequence omitted]

SEQ ID NO: 5 - DNA, 3617 bp, Homo sapiens
  GenBank Accession No. NM_000188
gaggaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaggacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaaaaaaaaaaaaaaaaa

SEQ ID NO: 6 - protein, 917 aa, Homo sapiens
  GenBank Accession No. NP_000179
MIAAQLLAYYFTELKDDQVKKIDKYLYAMRLSDETLIDIMTRFRKEMKNGLSRDFNPTATVKMLPTFVRSIPDGSEKGDFIALDLGGSSFRILRVQVNHEKNQNVHMESEVYDTPENIVHGSGSQLFDHVAECLGDFMEKRKIKDKKLPVGFTFSFPCQQSKIDEAILITWTKRFKASGVEGADVVKLLNKAIKKRGDYDANIVAVVNDTVGTMMTCGYDDQHCEVGLIIGTGTNACYMEELRHIDLVEGDEGRMCINTEWGAFGDDGSLEDIRTEFDREIDRGSLNPGKQLFEKMVSGMYLGELVRLILVKMAKEGLLFEGRITPELLTRGKFNTSDVSAIEKNKEGLHNAKEILTRLGVEPSDDDCVSVQHVCTIVSFRSANLVAATLGAILNRLRDNKGTPRLRTTVGVDGSLYKTHPQYSRRFHKTLRRLVPDSDVRFLLSESGSGKGAAMVTAVAYRLAEQHRQIEETLAHFHLTKDMLLEVKKRMRAEMELGLRKQTHNNAVVKMLPSFVRRTPDGTENGDFLALDLGGTNFRVLLVKIRSGKKRTVEMHNKIYAIPIEIMQGTGEELFDHIVSCISDFLDYMGIKGPRMPLGFTFSFPCQQTSLDAGILITWTKGFKATDCVGHDVVTLLRDAIKRREEFDLDVVAVVNDTVGTMMTCAYEEPTCEVGLIVGTGSNACYMEEMKNVEMVEGDQGQMCINMEWGAFGDNGCLDDIRTHYDRLVDEYSLNAGKQRYEKMISGMYLGEIVRNILIDFTKKGFLFRGQISETLKTRGIFETKFLSQIESDRLALLQVRAILQQLGLNSTCDDSILVKTVCGVVSRRAAQLCGAGMAAVVDKIRENRGLDRLNVTVGVDGTLYKLHPHFSRIMHQTVKELSPKCNVSFLLSEDGSGKGAALITAVGVRLRTEASS

SEQ ID NO: 7 - DNA, 7109 bp, Homo sapiens
  GenBank Accession No. NM_000189
tggattatgatttttgtttatttttcctgtttatccatatattatttttcaacaatgagtattgattacttatataataattttaaggctgtacacattgcagacagcaccccactgtttgaaaaactcctcctcagtagaacatggcagaccttcatcttccttccctgaaccttttccaaccttaggcttgccattctccaccagtgctaatgtcatgtctcttgaaatctgtattgaagtcagtatttcattcttgccagtttccactgtgtgtttaaatttggagtctggtgtctagcattagctggggttggagcttccactcctctcagcattggtaagcctcctcacccaccccatcccatgtccaagatcacccagttacacacttaccatctacccagttcattcacatcatcagtcccagagctgcagagatgctctttttctacctcctacttctctggctcttagagaggcagcatgggataatggggcaagcgaatagggccttaaagtagagggacaagggttctcttccctatctgccacttattagctatgtgacctcgtgtaagtctcttttctttttgagacagggtctccctctgtcacctaggctggagtacagtggtatgatcatagctcactgcagcctcgaactcctgggctcaagctatccttccaccttagccttctgagcagcagggactacaggcacatgccaccatgtccggctgatttatttatttttatttgggaagatgggggtctcactatgtcgcccaggctggtcatgaactcctggtctcaagcaaccctccaaccttggactcccaaagtgctgggattacaggtgtgagccctggccttgcctcaatttcctcatctgtaaaacggggttagtgaaactcacatcctatcagtggttttgaggatgggccgactcttgtattgcctgctctagtacaatcagcagctaaggcggctcactttccggccgtgctacaataggtaagaactaggatgctttagacgtgtgactgggcagtgggagcccctcacatgatcccgagatgccagacagtgtctctccgcacagggcgtgtgctggtccagaggcccgtttttccagtcgccccacaccccgggtccgcgatcacgctccccccacccatagccgagcctgacgcggcggtggctcatgcgcctttccgtcccagcctttagccacggaccacacgtcccatctcaggcgccccgcccctcccccgccccccgcccccggcgcgcctccccaggctgccggctccggtgtctgagcggccgcgcccgcgagccgtgagcgatgattggctgcgccacggcggcgggcggtccgtgggcgcacacaccctccccgcgcagccaatgggcgtgcgcacgtcactgatccggaggcccgcgggccggcagcccctcaataagccacattgttgcatgaaactccggcgcaggagtcccgggctgccgctggcaacatcgtgtcacccagctaagaaaatccgcgggcccgagccacgcgcctgtgaatcggagaggtcccactgcccgagtggagccgggctgagattcttctcaagttgagcctcagtgatcctgtggccgaagttagcgccttgacgtgggacaaccggacacgtcgccaggagagaactgaggcgccttctagcagttgtgacgccaaaatcacgtctccggagacccgcgccctccgccagccgggcgcaccctcgccggtagccttctttgtgcgccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccagctgtttgaccacattgccgaatgcctggctaacttcatggataagctacaaatcaaagacaagaagctcccactgggttttaccttctcgttcccctgccaccagactaaactagacgagagtttcctggtctcatggaccaagggattcaagtccagtggagtggaaggcagagacgttgtggctctgatccggaaggccatccagaggagaggggactttgatatcgacattgtggctgtggtgaatgacacagttgggaccatgatgacctgtggttatgatgaccacaactgtgagattggtctcattgtgggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaaggggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccattttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgagctctttgaccacattgtccagtgcatcgcggacttcctcgagtacatgggcatgaagggcgtgtccctgcctctgggttttaccttctccttcccctgccagcagaacagcctggacgagagcatcctcctcaagtggacaaaaggcttcaaggcatctggctgcgagggcgaggacgtggtgaccctgctgaaggaagcgatccaccggcgagaggagtttgacctggatgtggttgctgtggtgaacgacacagtcggaactatgatgacctgtggctttgaagaccctcactgtgaagttggcctcattgttggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggttcgagaaaatgatcagtggaatgtacctgggtgagattgtccgtaacattctcatcgatttcaccaagcgtggactactcttccgaggccgcatctcagagcggctcaagacaaggggcatctttgaaaccaagttcttgtctcagattgagagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctcctaaaacatgaaaattatctcccttagtaatcccccttgccaaattccatgtccctgtataattctacaggatggggacactaatgaagatacggttgcttcaccttggagcctgaacatgacatttctaagtggggtgcatcccccagcactgatgttgttactgattctcctgtcagagatctgggaggtctccactgaggatgtgagcctgattatcctataggcagacgtggggagggtggaggggtgacagtggaggaaaatccatggatatccacgcagcagcccctctttaacctcatctacaagcatttgccctgtggattccagcatttgccattcctggaatcaaggaatcctgagtctgggcaatgaaaccaaagccaggagttgacgcatcctgcagttgggccagctgtcgcatctcagcggggcgcacatgttatccacaagcaatggacctttggggaagggggagtttttagtttgttttacaaatttttcctgcaaaagtggaatcactgtattttcattttaatttatatttgaaattttatttagttcttgagtagatctgcttcttcatcttgacatgtaatgaatggtcagttgtacgtaatgtatttatatgttaatttgttatgtatatagatgtgcaagtcttgtcagaattggcctcagtgtagttaaagggcagaaggggaagatactgactagtcatagaaatacctcattcgcctgtgggaagagaagggaagcctcttcagggtgagtgaatggcaaagcggttgcttctggctcctccttcccctgtggtcttggaagtgtgtggaaggcagggacagagatggaggccgagccaatagactgaagagaccacagcaattggctcctccatctagagattttcttggcagtattccatgggatgttaagcaaaggaaaccaaaggaatcgtttcaaatggactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacacttttttttttttttttaaaggtagagatgtgtgtgtgtgtaggtattaaagatgtgttgttggtttccaaaaaggaacactggaaaataaattttgaatgtttatgttctcagaatcaggttgacagtcccttgctgacatggctttgctttgtgtaaatacagtggatctcaatcttcggggtgtgatgaatagcgaatcatctcaaatccttgagcactcagtctagtgaagatgttgtcattatgtacaatacataactagtttaattaactatgtgatgttaactattattaataaattttaacattttccaaaataaaaaaaaaaaaaaaaaa

SEQ ID NO: 8 - protein, 917 aa, Homo sapiens
  GenBank Accession No. NP_000180
MIASHLLAYFFTELNHDQVQKVDQYLYHMRLSDETLLEISKRFRKEMEKGLGATTHPTAAVKMLPTFVRSTPDGTEHGEFLALDLGGTNFRVLWVKVTDNGLQKVEMENQIYAIPEDIMRGSGTQLFDHIAECLANFMDKLQIKDKKLPLGFTFSFPCHQTKLDESFLVSWTKGFKSSGVEGRDVVALIRKAIQRRGDFDIDIVAVVNDTVGTMMTCGYDDHNCEIGLIVGTGSNACYMEEMRHIDMVEGDEGRMCINMEWGAFGDDGSLNDIRTEFDQEIDMGSLNPGKQLFEKMISGMYMGELVRLILVKMAKEELLFGGKLSPELLNTGRFETKDISDIEGEKDGIRKAREVLMRLGLDPTQEDCVATHRICQIVSTRSASLCAATLAAVLQRIKENKGEERLRSTIGVDGSVYKKHPHFAKRLHKTVRRLVPGCDVRFLRSEDGSGKGAAMVTAVAYRLADQHRARQKTLEHLQLSHDQLLEVKRRMKVEMERGLSKETHASAPVKMLPTYVCATPDGTEKGDFLALDLGGTNFRVLLVRVRNGKWGGVEMHNKIYAIPQEVMHGTGDELFDHIVQCIADFLEYMGMKGVSLPLGFTFSFPCQQNSLDESILLKWTKGFKASGCEGEDVVTLLKEAIHRREEFDLDVVAVVNDTVGTMMTCGFEDPHCEVGLIVGTGSNACYMEEMRNVELVEGEEGRMCVNMEWGAFGDNGCLDDFRTEFDVAVDELSLNPGKQRFEKMISGMYLGEIVRNILIDFTKRGLLFRGRISERLKTRGIFETKFLSQIESDCLALLQVRAILQHLGLESTCDDSIIVKEVCTVVARRAAQLCGAGMAAVVDRIRENRGLDALKVTVGVDGTLYKLHPHFAKVMHETVKDLAPKCDVSFLQSEDGSGKGAALITAVACRIREAGQR

SEQ ID NO: 9 - DNA, 2924 bp, Homo sapiens
  GenBank Accession No. NM_002626
gacggcgacgcggcgcaggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagcctcacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctcgggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggagaaaacaaaaaaa

SEQ ID NO: 10 - protein, 780 aa, Homo sapiens
  GenBank Accession No. NP_002617
MAAVDLEKLRASGAGKAIGVLTSGGDAQGMNAAVRAVTRMGIYVGAKVFLIYEGYEGLVEGGENIKQANWLSVSNIIQLGGTIIGSARCKAFTTREGRRAAAYNLVQHGITNLCVIGGDGSLTGANIFRSEWGSLLEELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 11 - DNA, 2204 bp, Homo sapiens
  GenBank Accession No. NM_001428
gtggggccccagagcgacgctgagtgcgtgcgggactcggagtacgtgacggagccccgagctctcatgcccgccacgccgccccgggccatcccccggagccccggctccgcacaccccagttcggctcaccggtcctatctggggccagagtttcgcccgcaccactacagggccgctggggagtcggggccccccagatctgcccgcctcaagtccgcgggacgtcacccccctttccacgctactgcagccgtcgcagtcccacccctttccgggaggtgagggaatgagtgacggctctcccgacgaatggcgaggcggagctgagggggcgtgccccggaggcgggaagtgggtggggctcgccttagctaggcaggaagtcggcgcgggcggcgcggacagtatctgtgggtacccggagcacggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaagctgtgggcaggcaagcccttcggtcacctgttggctacacagacccctcccctcgtgtcagctcaggcagctcgaggcccccgaccaacacttgcaggggtccctgctagttagcgccccaccgccgtggagttcgtaccgcttccttagaacttctacagaagccaagctccctggagccctgttggcagctctagctttgcagtcgtgtaattggcccaagtcattgtttttctcgcctcactttccaccaagtgtctagagtcatgtgagcctcgtgtcatctccggggtggccacaggctagatccccggtggttttgtgctcaaaataaaaagcctcagtgacccatgagaataaaaaaaaaaaaaaaaaa

SEQ ID NO: 12 - protein, 434 aa, Homo sapiens
  GenBank Accession No. NP_001419
MSILKIHAREIFDSRGNPTVEVDLFTSKGLFRAAVPSGASTGIYEALELRDNDKTRYMGKGVSKAVEHINKTIAPALVSKKLNVTEQEKIDKLMIEMDGTENKSKFGANAILGVSLAVCKAGAVEKGVPLYRHIADLAGNSEVILPVPAFNVINGGSHAGNKLAMQEFMILPVGAANFREAMRIGAEVYHNLKNVIKEKYGKDATNVGDEGGFAPNILENKEGLELLKTAIGKAGYTDKVVIGMDVAASEFFRSGKYDLDFKSPDDPSRYISPDQLADLYKSFIKDYPVVSIEDPFDQDDWGAWQKFTASAGIQVVGDDLTVTNPKRIAKAVNEKSCNCLLLKVNQIGSVTESLQACKLAQANGWGVMVSHRSGETEDTFIADLVVGLCTGQIKTGAPCRSERLAKYNQLLRIEEELGSKAKFAGRNFRNPLAK

SEQ ID NO: 13 - DNA, 2226 bp, Homo sapiens
  GenBank Accession No. NM_005566
gtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattatattaatttggaaatattaggctattcttgggcaaccctgcaacgattttttctaacagggatattattgactaatagcagaggatgtaatagtcaactgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggcagggaaaaaaaaaaaaaaaaaa

SEQ ID NO: 14 - protein, 332 aa, Homo sapiens
  GenBank Accession No. NP_005557
MATLKDQLIYNLLKEEQTPQNKITVVGVGAVGMACAISILMKDLADELALVDVIEDKLKGEMMDLQHGSLFLRTPKIVSGKDYNVTANSKLVIITAGARQQEGESRLNLVQRNVNIFKFIIPNVVKYSPNCKLLIVSNPVDILTYVAWKISGFPKNRVIGSGCNLDSARFRYLMGERLGVHPLSCHGWVLGEHGDSSVPVWSGMNVAGVSLKTLHPDLGTDKDKEQWKEVHKQVVESAYEVIKLKGYTSWAIGLSVADLAESIMKNLRRVHPVSTMIKGLYGIKDDVFLSVPCILGQNGISDLVKVTLTSEEEARLKKSADTLWGIQKELQF

SEQ ID NO: 15 - DNA, 1834 bp, Homo sapiens
  GenBank Accession No. NM_144563
cgggggcgggacttcagcggaggccggagcgaggcgtcgggatgcagcgccccgggcccttcagcaccctctacgggcgggtcttggccccgctgcccgggagggccgggggcgcggcctccggcggaggagggaacagctgggacctcccgggttcccacgtgcggctgccggggcgtgcacagtctgggacccgtggcggtgctggcaacacaagcaccagctgcggggactccaacagcatctgcccggccccctccacgatgtccaaggccgaggaggccaagaagctggcgggccgcgcggctgtggagaaccacgtgaggaataaccaagtgctgggaattggaagtggttctacaattgtccatgctgtgcagcgaatagctgaaagggtgaagcaagagaatctgaacctcgtctgtattcccacttccttccaggcccgccagctcatcctgcagtatggcttgaccctcagtgatctggatcgacacccagagatcgaccttgccatcgatggtgctgatgaagtagatgctgatctcaatctcatcaagggtggcggaggctgcctgacccaggagaagattgtggctggctatgctagtcgcttcatcgtgatcgctgatttcaggaaagattcgaagaatctcggggatcagtggcacaagggaatccccatcgaggtcatcccaatggcctatgtcccagtgagccgagctgtgagccagaagtttgggggcgtggttgaacttcgaatggctgtcaacaaggctggtcctgtggtgacagataatgggaattttatcttggactggaagtttgaccgggtacacaaatggagtgaagtgaatacagctatcaaaatgatcccaggtgtggtggacacaggcctattcatcaacatggctgagagagtctactttgggatgcaggatggctcagtgaacatgagggagaagcctttctgttgaccctgcaaggagcagagtgtgttcaccttgagtctccagcccacagccaaggtggacgtacctctccaggagcctttgccttaatgtatctctgcctggacaacttgtggtggggggtggggggaagagtgggagggggagttaaatccagtcttatgaagtattgttattaaatgtctttttaaaaagagaaatataaacatatatttttactattaaaatattcagttttttaaatgaagtagaacttgagttcatgttttatatgaaatatttaccaaaaaaaaaaaatgaggtaaactgtatttaaaacctttgacttgagtctgctggtaaagcttctgaatattgagtttgctgagaaataaaaatcaaaacttctttaagctggtaaagtgaggggcccaccagcagtgatctcctgatgccttactggaaactttgtttacttgtctgctaccctctgatttgtttttagttagtttttattgtgagcacacatagtacctagttacatcttaagatcaggtttataaaactgtggagtggagcggtatggtatggaatgacttggaatgtaagctgtcagggagaaaatgttgttacacttttgctaagatctgggggtttcttcatattcctgctgttggaagcagttgaccagaaatgcttgccagtactgccaaagcactgctgtgaaatgtgaagtactttgtttttttatttttaatgattttctttttgttattaatatttttctctgttcctttgttattacttgcatggtttggcgtcagaagtccttacctctttatattgtttgcaggtttaaataaaacagtgtggtgccattttga

SEQ ID NO: 16 - protein, 311 aa, Homo sapiens
  GenBank Accession No. NP_653164
MQRPGPFSTLYGRVLAPLPGRAGGAASGGGGNSWDLPGSHVRLPGRAQSGTRGGAGNTSTSCGDSNSICPAPSTMSKAEEAKKLAGRAAVENHVRNNQVLGIGSGSTIVHAVQRIAERVKQENLNLVCIPTSFQARQLILQYGLTLSDLDRHPEIDLAIDGADEVDADLNLIKGGGGCLTQEKIVAGYASRFIVIADFRKDSKNLGDQWHKGIPIEVIPMAYVPVSRAVSQKFGGVVELRMAVNKAGPVVTDNGNFILDWKFDRVHKWSEVNTAIKMIPGVVDTGLFINMAERVYFGMQDGSVNMREKPFC

SEQ ID NO: 17 - DNA, 2492 bp, Homo sapiens
  GenBank Accession No. NM_199229
gcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaatagacttcttgaggctactataagttttgagaaataaggttcaaaaaataagaatgctaacacttaagcacagactagagcttgcttgggtttcttcctgcattacaaggtaaaaatttgttaatgtttgtttttattcagcttgggaaagctttgtgccatgaatacgtcgcatttaataacaagcaacacacggcatatagaaataactttaattaaaaaacttacatagaagattataatatcagacgtgacaaagatttgagtttatttgcctggacaacttgggtttgtctggcttttgttttctttttctttaaaaataaatgtacagtaaaactaaaaaaaaaaaaaaaaaaaaaaaaa

SEQ ID NO: 18 - protein, 228 aa, Homo sapiens
  GenBank Accession No. NP_954699
MASGCKIGPSILNSDLANLGAECLRMLDSGADYLHLDVMDGHFVPNITFGHPVVESLRKQLGQDPFFDMHMMVSKPEQWVKPMAVAGANQYTFHLEATENPGALIKDIRENGMKVGLAIKPGTSVEYLAPWANQIDMALVMTVEPGFGGQKFMEDMMPKVHWLRTQFPSLDIEVDGGVGPDTVHKCAEAGANMIVSGSAIMRSEDPRSVINLLRNVCSEAAQKRSLDR

SEQ ID NO: 19 - DNA, 8703 bp, Homo sapiens
  GenBank Accession No. NM_001244710
ggttgctggcggagcccgggaggcggagaaggctgtcgttgccttggccgtcgcatccccgagggagtcgtgtcggcgccaccccggcccccgagcccgcagattgcccaccgaagctcgtgtgtgcacccccgatcccgccagccactcgcccctggcctcgcgggccgtgtctccggcatcatgtgtggtatatttgcttacttaaactaccatgttcctcgaacgagacgagaaatcctggagaccctaatcaaaggccttcagagactggagtacagaggatatgattctgctggtgtgggatttgatggaggcaatgataaagattgggaagccaatgcctgcaaaatccagcttattaagaagaaaggaaaagttaaggcactggatgaagaagttcacaagcaacaagatatggatttggatatagaatttgatgtacaccttggaatagctcatacccgttgggcaacacatggagaacccagtcctgtcaatagccacccccagcgctctgataaaaataatgaatttatcgttattcacaatggaatcatcaccaactacaaagacttgaaaaagtttttggaaagcaaaggctatgacttcgaatctgaaacagacacagagacaattgccaagctcgttaagtatatgtatgacaatcgggaaagtcaagataccagctttactaccttggtggagagagttatccaacaattggaaggtgcttttgcacttgtgtttaaaagtgttcattttcccgggcaagcagttggcacaaggcgaggtagccctctgttgattggtgtacggagtgaacataaactttctactgatcacattcctatactctacagaacagctaggactcagattggatcaaaattcacacggtggggatcacagggagaaagaggcaaagacaagaaaggaagctgcaatctctctcgtgtggacagcacaacctgccttttcccggtggaagaaaaagcagtggagtattactttgcttctgatgcaagtgctgtcatagaacacaccaatcgcgtcatctttctggaagatgatgatgttgcagcagtagtggatggacgtctttctatccatcgaattaaacgaactgcaggagatcaccccggacgagctgtgcaaacactccagatggaactccagcagatcatgaagggcaacttcagttcatttatgcagaaggaaatatttgagcagccagagtctgtcgtgaacacaatgagaggaagagtcaactttgatgactatactgtgaatttgggtggtttgaaggatcacataaaggagatccagagatgccggcgtttgattcttattgcttgtggaacaagttaccatgctggtgtagcaacacgtcaagttcttgaggagctgactgagttgcctgtgatggtggaactagcaagtgacttcctggacagaaacacaccagtctttcgagatgatgtttgctttttccttagtcaatcaggtgagacagcagatactttgatgggtcttcgttactgtaaggagagaggagctttaactgtggggatcacaaacacagttggcagttccatatcacgggagacagattgtggagttcatattaatgctggtcctgagattggtgtggccagtacaaaggcttataccagccagtttgtatcccttgtgatgtttgcccttatgatgtgtgatgatcggatctccatgcaagaaagacgcaaagagatcatgcttggattgaaacggctgcctgatttgattaaggaagtactgagcatggatgacgaaattcagaaactagcaacagaactttatcatcagaagtcagttctgataatgggacgaggctatcattatgctacttgtcttgaaggggcactgaaaatcaaagaaattacttatatgcactctgaaggcatccttgctggtgaattgaaacatggccctctggctttggtggataaattgatgcctgtgatcatgatcatcatgagagatcacacttatgccaagtgtcagaatgctcttcagcaagtggttgctcggcaggggcggcctgtggtaatttgtgataaggaggatactgagaccattaagaacacaaaaagaacgatcaaggtgccccactcagtggactgcttgcagggcattctcagcgtgatccctttacagttgctggctttccaccttgctgtgctgagaggctatgatgttgatttcccacggaatcttgccaaatctgtgactgtagagtgaggaatatctatacaaaatgtacgaaactgtatgattaagcaacacaagacaccttttgtatttaaaaccttgatttaaaatatcaccccttgaagcctttttttagtaaatccttatttatatatcagttataattattccactcaatatgtgatttttgtgaagttacctcttacattttcccagtaatttgtggaggactttgaataatggaatctatattggaatctgtatcagaaagattctagctattattttctttaaagaatgctgggtgttgcatttctggaccctccacttcaatctgagaagacaatatgtttctaaaaattggtacttgtttcaccatacttcattcagaccagtgaaagagtagtgcatttaattggagtatctaaagccagtggcagtgtatgctcatacttggacagttagggaagggtttgccaagttttaagagaagatgtgatttattttgaaatttgtttctgttttgtttttaaatcaaactgtaaaacttaaaactgaaaaattttattggtaggatttatatctaagtttggttagccttagtttctcagacttgttgtctattatctgtaggtggaagaaatttaggaagcgaaatattacagtagtgcattggtgggtctcaatccttaacatatttgcacaattttatagcacaaactttaaattcaagctgctttggacaactgacaatatgattttaaatttgaagatgggatgtgtacatgttgggtatcctactactttgtgttttcatctcctaaaagtggtttttatttccttgtatctgtagtcttttattttttaaatgactgctgaatgacatattttatcttgttctttaaaatcacaacacagagctgctattaaattaatattgatatattcagtattctcttcaactttgtcacgaggaagaatttcctgtagttaattttaactttccttcattacattgttgcataaaactagtcccttagtgccagtttggaagttacttgcaattgtttggaagatttgcaggtcgctgacctcatcatttcactctaagtatatgtggtaggctaagctcagaaaaaggtatgtatgctttacactgataggcaccaaatttagtattgtatcctaagtatttttcctcttctgtattttctgtgctctacccctgaaatatatttaggaataaagaagatataaataaagtgatattggggtatgttcagcttgtaagtgtcagaaatggaagttgacaatttggattaaaatatttaaagtagaatgttattatttgatacccccaaaattgtgagtaataatttcttaatggagcttttctggccagatcttcagggctataggagagtgtgtttgtttttggtgaagtccttctttttcaaaggtttttacttttaaattgtgaagataagctatttagcacaattatttaagtaagctgttttttcctttcttttctttcttttcttgttttaacttctgggtgaggttaagattttctaatagttattgttgttgccagagaagcatagaattctgcttgtgtcttagggttagagaaagatttgttatattttgaggtaatttggaaggactttcatacatggtgactagaaacctgatctttttaagaataaaatagggtcactatttacattatatataatatatggctattatagctatattaatctactttaattgtttctaagattattttgtgtaagtcagctagcgtgtgtatagtgtcatttcttatgttttgtatattaacgttttacaaacacaatttgtgtgggtttgtagcatttcttatagtttaaagtatgattcagcattctaagttaaaactaatatgtgaagtcagtcattagtctgcataatctctgtctccctctgtgtgtgtctttctataaagcacatgtgtacacacacacacacaaatatactgaaagctagggtaagttctaaactgaatatcaaaaaccaaaatcaagaacaaagaagtgatattttccaaacaaacatggattctctgccgggtgcagtggctcagcctgtaataccagcctccactttgggagtctgaggtgggagtattgcttgagctcaagagttggagaacagcctgggcaacatggtgagacctggtctttacaaaaatttttttggccggacgcagtggctcacacctgtaatcccagcactttgggaggccgaggcaggttgatcatgaggtcaagagatcgagaccatcctggccaacatggtgaaaccccgtctttactaaaaatacaaaaattagctgggagtggtggcgtgcgcctgtagtcccaactacttgggaggctgaggcaggagaatcgcttgaacccaggaggcggaggttgcagtgaggcgagatcacgccactacactccagcctggcgacagagcaagactctctcaaaaaaaaaaaaaaaaaattttttttttaaatgggctgggcatggtggcttgtgcctgtagtctcagcaacttgggaggcttaagtagtaggatcgcttgagcctgggaggttgaggctgcagtgagctgtgattgtgccactgtgcttcagcttgagtgacagagtgagaccctcctgactcaaaacaaaaaacatggtttctcctctctctcctgtcttcttactctctatcccatttgatgtagtgatttttaaatgcttttgtaagttaattcttaacacaaaagagacattgtaatgaggcacaccactaaagtgagcatgcccaattaaaaccagtgtaatataggataagaaaatctgatttttcaaaaaagatactctacataaagaatccttcatataaaaagttctttcttgtagtacatttaaagttttaattcactcatgtataactgagagttcctttgagccctttttaggcagggaggcatgtctgtcatctagcgtgtggcccagtaagtgattattacattggaatcagtttttcagtcttttaaaataaattctgtgccataagaataaaagataaagagaaaaattaatgttaactatttttagcttattataactatgtcaacaagtgtttattaatacctattatgggaaagtcactgtggttggcattgaaaattacatcatctttaaagcagtatttgtccccagatggactcatcactagcaaagactaggttcattggaaggcatagggtgagagaatgggaagatgaagtggaggcgggttgttaaagtgctgtcagtgagtgattttgtctacttgaataatggtccatgtttgggggcatattgtgtttcataagaagtgaaaggtatttgcaaagtaagctacaaatgacccataaatctgttaacaacagtccttaatatgcaaagatgaaaaacaagcattactgctacccaaagggaactggtgcttggtgatgtgcagatggggctgttggttaagagagctattacaggttttctctcttaggtttcataggaggtagttactgagatgagattgttttatctttttgaatacagatctcttgtcttgagttagttctgaggatgggagtaataaaggagttttttgtttttttgtttgtttgtttgttttggctccttagtaatactcctctgacatttatttctattattcttcaaagaaaggaaaccaactgaaatgtttgctttaacaaacattttaataagttctctgggtttttttttccccttttaaaaaaattagcatataccatagcaataaaagaactaatgttaactattgtatgctacaacttaagtgatttttctaaagaagcacaatgtcattgaaagtattattgaaaaggatcatagtcacattgaatttgtgaaggccaaagaaattgaagggagtgatattttcattttatgatattcacatatttagtaaattttgtgtacaagaataccaggcagagtgttttacccatggaaacaggtttcagattactttatttttactgttagagtctcaagtttagaaatgctaacacttaaatcagtttttttctcactatacttgaagattgttaatattttgatatcttcctagcttgatgaatttaaacatatcttcagatctgtgacagtgacagccaataggactgataatattagcttcaaaccaataatatccagggttaaaataaaaatcatagtgaaagtacgattgtaaaattatgctatattaacttttaagtctgtaataacttgacatcaaaatgttatgtaattaccataaataatggctagcgagaacatctttggaaattctcaaattacctttcttactacactgtttgcagaatgaatgtagaaatgatcctgttagctttctgaatgttctgtggttgaatgtgtttttgcttaaataaagcttttggtatttgtttaaattacacttcttgagaagtggaaattttaggatcatctttgctttgtttcagttttgtgatttttgaaatgaatgtttagtttactgagccagttggtcatttcttcctcatgtcgttaagtccagtgagtaagcctgaactgtgaataaattaccaaaaacttgcttagaatttcattttgaagcaatttgctaatatttgaagtgtatacacatttgtagttatgttagaaattgtattgtactaagaatgtaatcaatgtctactttagttgtaaacatttctgatgtcaaaactttattcattactgttgattttaagaataagaaatcactgcctaaatattaccaaaagccactgtctctacccgaacttcccagtttgggaaagaatcgttagataaaacaaaggctctgccctttctgataccaaactccacagatactttctcacatcttttaaaacattttgcaataacatattgtttataggaagtttacggggtatgcaatgattaaaacttttaagtgaattgatagttgcaaaagaaaggataatatttaaggtcagtgagtagcaagacaatctaaagtttctgtaatatctggctctctgttaattatagagcaaagtttcccttacagaatccttttatgaacagcaagctagagtctatccctagtggttatagcacctgctgcgtttttcaggagacagttaggccagggtgatttgaatggatagatgtgctgttttgcctgcttgtagaattcagcccagtctttggtctctctctctctctccctcctccacctctccctctctcttcttctgcaccagagcctaaggctgcgccaccaagatgcgtcattttttccagaggcttcttttttttttttttgagatggagttttgctctgttgcccaggctggcatgcagtgctgcaatcttggctgactgcaacttccacctcccgtgttcacacgagtcttttgcctcagcctctggattagctgggattacaggcacgtgccaccatgcctagctaatttttgtgtttttagtagagacggggtttcaccatgttggccaggctagtctcaaactcctgaccttaagtgatctgcccgccttggcctcccaaagtgctgggattacaggcatgagtcaccgtgtcctgcccagacatatcaaatttgacaggtattgtataccctttggatctttaggaattaatttttgcctctgtcactcagctttgtatattttgaaatggagataagtatagggaggtcttggaaggaaaattgccagaattcccaaaccatgtaacactcattgagaattccagatccattatatctaaagggcaagtgaaggaaacagtattgtgaactgggtataactccttggttcttaactagtacattcttaatctgtgagacccaaaggttgataaacaataatttaagattgtacagtactctaaacgtctgcaaaggtctagatgttatcagtatcactagtttttatttctgccagtagctcccttttaggttacattgttgtcctctttccagtgtcgcatctgtcattggtttttcactatggcaagttcattaaaaagcttgctccattgttatcttcaagtaatgcccataaggagatggaagatatctgagacaattaaggctttagcttctaggcaagagaaataacgttgcattaaatttcaagtttctttctgctagacttgaatgtgtctagccactctaatttatgggggcttttggttttttcctattgtactttgtatgtagaattgttttgaaatatcaagcatatttactttgaatttgaactctttcttaattttgtatttatcctttgaataaaatgtaaatccaatatttattatt

SEQ ID NO: 20 - protein, 699 aa, Homo sapiens
  GenBank Accession No. NP_001231639
MCGIFAYLNYHVPRTRREILETLIKGLQRLEYRGYDSAGVGFDGGNDKDWEANACKIQLIKKKGKVKALDEEVHKQQDMDLDIEFDVHLGIAHTRWATHGEPSPVNSHPQRSDKNNEFIVIHNGIITNYKDLKKFLESKGYDFESETDTETIAKLVKYMYDNRESQDTSFTTLVERVIQQLEGAFALVFKSVHFPGQAVGTRRGSPLLIGVRSEHKLSTDHIPILYRTARTQIGSKFTRWGSQGERGKDKKGSCNLSRVDSTTCLFPVEEKAVEYYFASDASAVIEHTNRVIFLEDDDVAAVVDGRLSIHRIKRTAGDHPGRAVQTLQMELQQIMKGNFSSFMQKEIFEQPESVVNTMRGRVNFDDYTVNLGGLKDHIKEIQRCRRLILIACGTSYHAGVATRQVLEELTELPVMVELASDFLDRNTPVFRDDVCFFLSQSGETADTLMGLRYCKERGALTVGITNTVGSSISRETDCGVHINAGPEIGVASTKAYTSQFVSLVMFALMMCDDRISMQERRKEIMLGLKRLPDLIKEVLSMDDEIQKLATELYHQKSVLIMGRGYHYATCLEGALKIKEITYMHSEGILAGELKHGPLALVDKLMPVIMIIMRDHTYAKCQNALQQVVARQGRPVVICDKEDTETIKNTKRTIKVPHSVDCLQGILSVIPLQLLAFHLAVLRGYDVDFPRNLAKSVTVE

SEQ ID NO: 21 - DNA, 2283 bp, Homo sapiens
  GenBank Accession No. NM_003778
tttccgcgttctcccctctccgcgggcagtgctagctcgccgcggccgcctccggggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagaggccagagcaagctcattttcaaaccagatctcactttggaagaggtacaggcagaaaatcccaaagtgtccagaggccggtatcgccctcaggaatgtaaagctttacagagggtcgccatcctcgttccccaccggaacagagagaaacacctgatgtacctgctggaacatctgcatcccttcctgcagaggcagcagctggattatggcatctacgtcatccaccaggctgaaggtaaaaagtttaatcgagccaaactcttgaatgtgggctatctagaagccctcaaggaagaaaattgggactgctttatattccacgatgtggacctggtacccgagaatgactttaacctttacaagtgtgaggagcatcccaagcatctggtggttggcaggaacagcactgggtacaggttacgttacagtggatattttgggggtgttactgccctaagcagagagcagtttttcaaggtgaatggattctctaacaactactggggatggggaggcgaagacgatgacctcagactcagggttgagctccaaagaatgaaaatttcccggcccctgcctgaagtgggtaaatatacaatggtcttccacactagagacaaaggcaatgaggtgaacgcagaacggatgaagctcttacaccaagtgtcacgagtctggagaacagatgggttgagtagttgttcttataaattagtatctgtggaacacaatcctttatatatcaacatcacagtggatttctggtttggtgcatgaccctgggtcttttggtgatgtttggaagaactgattctttgtttgcaataattttggcctagagacttcaaatagtagcacacattaagaacctgttacagctcattgttgagctgaatttttcctttttgtattttcttagcagagctcctggtgatgtagagtataaaacagttgtaacaagacagctttcttagtcattttgatcatgagggttaaatattgtaatatggatacttgaaggactttatataaaaggatgactcaaaggataaaatgaacgctatttgaggactctggttgaaggagatttatttaaatttgaagtaatatattatgggataaaaggccacaggaaataagactgctgaatgtctgagagaaccagagttgttctcgtccaaggtagaaaggtacgaagatacaatactgttattcatttatcctgtacaatcatctgtgaagtggtggtgtcaggtgagaaggcgtccacaaaagaggggagaaaaggcgacgaatcaggacacagtgaacttgggaatgaagaggtagcaggagggtggagtgtcggctgcaaaggcagcagtagctgagctggttgcagctgctgatagccttcaggggaggacctgcccaggtatgccttccagtgatgcccaccagagaatacattctctattagtttttaaagagtttttgtaaaatgattttgtacaagtaggatatgaattagcagtttacaagtttacatattaactaataataaatatgtctatcaaatacctctgtagtaaaatgtgaaaaagcaaaaaaaaaaaaaaaaaaaaaa

SEQ ID NO: 22 - protein, 344 aa, Homo sapiens
  GenBank Accession No. NP_003769
MGFNLTFHLSYKFRLLLLLTLCLTVVGWATSNYFVGAIQEIPKAKEFMANFHKTLILGKGKTLTNEASTKKVELDNCPSVSPYLRGQSKLIFKPDLTLEEVQAENPKVSRGRYRPQECKALQRVAILVPHRNREKHLMYLLEHLHPFLQRQQLDYGIYVIHQAEGKKFNRAKLLNVGYLEALKEENWDCFIFHDVDLVPENDFNLYKCEEHPKHLVVGRNSTGYRLRYSGYFGGVTALSREQFFKVNGFSNNYWGWGGEDDDLRLRVELQRMKISRPLPEVGKYTMVFHTRDKGNEVNAERMKLLHQVSRVWRTDGLSSCSYKLVSVEHNPLYINITVDFWFGA

SEQ ID NO: 23 - DNA, 4743 bp, Homo sapiens
  GenBank Accession No. NM_004776
cgcttcatgtggcccggcccgcgacggccggcggctgggagcggcgaggcggcggcggcggcgagtggcggcccgcgaggcccgggaggcggtggccgaggcccaggcggtggcggcggcggcccaggaggcggcggacggggagctgcgggagcaggcccggcctggctctctagcggccgcctggctgcagcatgcgcgcccgccgggggctgctgcggctgccgcgccgctcgctgctcgccgcgctcttcttcttttctctctcgtcctcgctgctgtacttcgtctatgtggcgcccggcatagtgaacacctacctcttcatgatgcaagcccaaggcattctgatccgggacaacgtgagaacaatcggtgctcaggtttatgagcaggtgcttcggagtgcttatgccaagaggaacagcagtgtaaatgactcagattatcctcttgacttgaaccacagtgaaaccttcctgcaaactacaacatttcttcctgaagacttcacctactttgcaaaccatacctgccctgaaagactcccttccatgaagggcccaatagacataaacatgagtgaaattggaatggattacattcatgaactcttctccaaagacccaaccatcaagctcggaggtcactggaagccttctgattgcatgcctcggtggaaggtggcgatccttatccccttccggaaccgccacgagcacctcccagtcctgttcagacacctgcttcccatgctccagcgccagcgcttgcagtttgcattttatgtggttgaacaagttggtacccaaccctttaatcgagccatgcttttcaacgttggctttcaagaggcaatgaaagacttggattgggactgtttgatttttcatgatgtagatcacataccggaaagtgatcgcaactattatggatgtggacagatgccgaggcattttgcaaccaaattggataagtatatgtatctgcttccttataccgagttctttggcggagtgagtggcttaacagtggaacaatttcggaaaatcaatggctttcctaatgctttctggggttggggtggagaagatgacgacctctggaacagagtacagaatgcaggctattctgtgagccggccagagggtgacacaggaaagtacaagtccattcctcatcaccatcgaggagaagtccagtttcttggaaggtatgctctgctgaggaagtcaaaagaacggcaagggctggatggcctcaacaacctgaactactttgcaaacatcacatacgacgccttgtataaaaacataactgtcaacctgacacccgagctggctcaggtgaacgagtactgagaggagagaatgtacgtttgctttacccaccgccaccaagaaagcagtccgatgagatttttttttggaggggggagggtctacacagcaagagaacagaaatactgtgtctcatgaaggatcacagagttcagggggaaaatgtgacagcacacgcacaaacgccttcactggatcagccgctggaactgagggagtgagcttggggacttccttcgtcagcactggctttctgttttcacaagacagacgtctgtcccgctgctctctccccatctcctaccccacatcctgtcttagccgcagtctccagaacccatgatgaactgtgatctgccgtggtcctgccgtggtcctgccgtggagcctgtccctacacatgaccttggagcctcttggccttcagagcagaggcaaacccaccacagggcagctgcgttttaggaagagcaaatgaaactccacaccattcttctagatctctggtgttctctttggtttcatttttttaaaaaattaccttctttgggtggggattgagggtggaggggagggtgtttgggaaagataaatagacataaatatataacaatcacttcttgaagaagtataattgtaaataagccatgtaaaatgcctttttaaaatttaattttctagctggctccaattcaaattgaggatttatgtattaggccacttacttggttggcaagtgcaggaactcagttaaaatgcagttgaagaatgtcatctcccgaattgctgtcactttggcgagggagtggatatagggcatgtcacaaaagaacaaaataacccgacctttattgctgggagctggcttctgtccctttcttcccccccccacgagtcttgcccttgacttctgctctggattcactcttccctgtcggccgcgcatgtgctcatcccactctccgctaagcgggaggctgctgttagagcaggctgcttcctgcctaaagcaggcccttcggggctcgctgcacacacatctctggctctccaggcttcgtgttctgtcttttcatcagcatggcggggcggggggcggggggcgggggtgtgtatgggaatccctccccctcttactttttctcttgtggaacttggccacagtttctgaacaatgtgcctacattaccagctggcttcagtgattcctctgtgtccctttttggtttctggaaagattctttgtcaacattagtaactgatacatagaaccaaggagcactcaaatagggagccaggagccagggagctggtgacacttgtgtgctgtggggcagctgggatccaggtaagaccggattgaagctttgaaattagactaacaaagctccagacagcaagagcccaggtgcactgctcacacccccacctgcattttgaagtcatattattttttgttttgttttttaagacggtctggctctgtcgcctaagctggagtgtggtggcacgatcacagctcactgcagcctccatctcctaggctcaagccattttcccacctcagcctcccgagtagctgggactacaggtgcacaccaccacacctggctaattttttgtatttttagtagagacaggggtttcttccatgttgcccaggctggtctcgaactcctggactcaagcaatccgcccaccttgacttcccaaagtgctgggattatgggcgggtgtgagccattgcgcccagccttgaagtcatgttctaaattgtatttgaatttgtgcctctttgtttttccccaaaccaaagccctcaaattgtagtctctgtcggcttctgcagaattctggaaaatgccagttttcctcccccgcccttgttttccataaaacatatttatatattgtgatgaggagtactttctgaagagtacttcgtatttttttttaattgccttgtttgccttcaacttccttgattttcatagtttacatgggtgtgtgtaggggtgtgtgtgtgtatgtgtgtgggttagggcttttttcgttgcatgtgatggttctgtggacatatgatccccacaaactgtgggagtgattggccaggccttgttttgtttgtttgtttgtttgtgtttttgttcttttgaagaatagagtggtatttagaaaataaattgcattgcaaagctcttatcggctcatatgagagagcaggttcctgcccttgaaaatgccggtaagctatagcatatgttttttaagacttaagcatttcatgctttaaaataccttcacaagtgaacattacacacagaagttcatttggttttcctttgttttatggtgcatatagcaataaagacccccctccaccctgcaacccccatcccccaccgggcctttgtccctgccttggcttttctccccttctcattctcctctcccctttcctcactgaaggctgtgagttgctttcaatgtgacaacactatgatgtcatttggaaggatttgccaggacagactgattctgagtcctgggtgccgtatgtgtatgcggcagtgttgtcaggcgatcttgtttgaagctctatgttgccataattaccatcaagtacacactgttggcaaaaggctaacacctgactttagaaaatgctgatttgagaacaaaaggaaaggtcttttttcactgcttaaagtggggtcactttgatacctttgcggtcatgtctgtgtctgatgagtgtagaatctctggatgtgcactgtcagtcatgtgtccaccaggcctcgaatatcatatgggaaatgtcatagttaaaaacgtacagccaggcccgtgtgctgttaatagtgtgaaattgtcatgttaaaaaaaaaaacaggaaccaaatgtgaccttgtgcatatattggtagctgaaaatcttcaaggctactgatgggtggccccttaatcttgtctttgattgctgtgtgcagggaaaggtgtccccgtttgttcatgctgttttggggggtgggggggtatttgcaagaatactcattttgacataataggtcctcttgtcagagatcctctaccacagacattaatagctgagcaggagccacatggattgattgtatccactcaccattgacgatggcattgagcgtagctagcttatttccatcactacgtgtttttgagcttgctcttacgttttaagaggtgccaggggtacatttttgcactgaaatctaaagatgttttaaaaaacacttttcacaaaaatagtcctttgtcattacattatttactcatgtgtttgtacatttttgtatgttaatttatgaatgattttttcagtaaaaaatacatattcaagaaccaaaaaaaaaaaaaaaaaa

SEQ ID NO: 24 - protein, 388 aa, Homo sapiens
  GenBank Accession No. NP_004767
MRARRGLLRLPRRSLLAALFFFSLSSSLLYFVYVAPGIVNTYLFMMQAQGILIRDNVRTIGAQVYEQVLRSAYAKRNSSVNDSDYPLDLNHSETFLQTTTFLPEDFTYFANHTCPERLPSMKGPIDINMSEIGMDYIHELFSKDPTIKLGGHWKPSDCMPRWKVAILIPFRNRHEHLPVLFRHLLPMLQRQRLQFAFYVVEQVGTQPFNRAMLFNVGFQEAMKDLDWDCLIFHDVDHIPESDRNYYGCGQMPRHFATKLDKYMYLLPYTEFFGGVSGLTVEQFRKINGFPNAFWGWGGEDDDLWNRVQNAGYSVSRPEGDTGKYKSIPHHHRGEVQFLGRYALLRKSKERQGLDGLNNLNYFANITYDALYKNITVNLTPELAQVNEY

SEQ ID NO: 25 - DNA, 1915 bp, Homo sapiens
  GenBank Accession No. NM_152692
cgcgggcgggcaaacggacggctccgcccagccgccggctcctttaccccgccccactacccccgccttcgcggcgctcgtttcctggcgctccccacctttagcgagaccaacgagagaacaccgcctgcagctagaacagcctggtcaggagcgtaacggagtggtgcgccaacgtgagaggaaacccgtgcgcggctgcgctttcctgtccccaagccgttctagacgcggatgaagtgcaaaacaaacttctccatagaggagttgttgcaaagttccagtttataccaaacagtaatcagattccattggaagctaaagattttgagagccttttgtactatatgcaactaacttgatttcaagcttgggaaccttttaaaaaaaacattaaaagcaaaatgaaaaatgctttctgaaagcagctcctttttgaagggtgtgatgcttggaagcattttctgtgctttgatcactatgctaggacacattaggattggtcatggaaatagaatgcaccaccatgagcatcatcacctacaagctcctaacaaagaagatatcttgaaaatttcagaggatgagcgcatggagctcagtaagagctttcgagtatactgtattatccttgtaaaacccaaagatgtgagtctttgggctgcagtaaaggagacttggaccaaacactgtgacaaagcagagttcttcagttctgaaaatgttaaagtgtttgagtcaattaatatggacacaaatgacatgtggttaatgatgagaaaagcttacaaatacgcctttgataagtatagagaccaatacaactggttcttccttgcacgccccactacgtttgctatcattgaaaacctaaagtattttttgttaaaaaaggatccatcacagcctttctatctaggccacactataaaatctggagaccttgaatatgtgggtatggaaggaggaattgtcttaagtgtagaatcaatgaaaagacttaacagccttctcaatatcccagaaaagtgtcctgaacagggagggatgatttggaagatatctgaagataaacagctagcagtttgcctgaaatatgctggagtatttgcagaaaatgcagaagatgctgatggaaaagatgtatttaataccaaatctgttgggctttctattaaagaggcaatgacttatcaccccaaccaggtagtagaaggctgttgttcagatatggctgttacttttaatggactgactccaaatcagatgcatgtgatgatgtatggggtataccgccttagggcatttgggcatattttcaatgatgcattggttttcttacctccaaatggttctgacaatgactgagaagtggtagaaaagcgtgaatatgatctttgtataggacgtgtgttgtcattatttgtagtagtaactacatatccaatacagctgtatgtttctttttcttttctaatttggtggcactggtataaccacacattaaagtcagtagtacatttttaaatgagggtggtttttttctttaaaacacatgaacattgtaaatgtgttggaaagaagtgttttaagaataataattttgcaaataaactattaataaatattatatgtgataaattctaaattatgaacattagaaatctgtggggcacatatttttgctgattggttaaaaaattttaacaggtctttagcgttctaagatatgcaaatgatatctctagttgtgaatttgtgattaaagtaaaacttttagctgtgtgttccctttacttctaatactgatttatgttctaagcctccccaagttccaatggatttgccttctcaaaatgtacaactaagcaactaaagaaaattaaagtgaaagttgaaaaataaaaaaaaaaaa

SEQ ID NO: 26 - protein, 318 aa, Homo sapiens
  GenBank Accession No. NP_689905
MLSESSSFLKGVMLGSIFCALITMLGHIRIGHGNRMHHHEHHHLQAPNKEDILKISEDERMELSKSFRVYCIILVKPKDVSLWAAVKETWTKHCDKAEFFSSENVKVFESINMDTNDMWLMMRKAYKYAFDKYRDQYNWFFLARPTTFAIIENLKYFLLKKDPSQPFYLGHTIKSGDLEYVGMEGGIVLSVESMKRLNSLLNIPEKCPEQGGMIWKISEDKQLAVCLKYAGVFAENAEDADGKDVFNTKSVGLSIKEAMTYHPNQVVEGCCSDMAVTFNGLTPNQMHVMMYGVYRLRAFGHIFNDALVFLPPNGSDND

SEQ ID NO: 27 - DNA, 2752 bp, Homo sapiens
  GenBank Accession No. NM_024642
atgtgggggcgcacggcgcggcggcgctgcccgcgggaactgcggcgcggccgggaggcgctgttggtgctcctggcgctactggcgttggccgggctgggctcggtgctgcgggcgcagcgtggggccggggccggggctgccgagccgggacccccgcgcaccccgcgccccgggcggcgcgagccggtcatgccgcggccgccggtgccggcgaacgcgctgggcgcgcggggcgaggcggtgcggctgcagctgcagggcgaggagctgcggctgcaggaggagagcgtgcggctgcaccagattaacatctacctcagcgaccgcatctcactgcaccgccgcctgcccgagcgctggaacccgctgtgcaaagagaagaaatatgattatgataatttgcccaggacatctgttatcatagcattttataatgaagcctggtcaactctccttcggacagtttacagtgtccttgagacatccccggatatcctgctagaagaagtgatccttgtagatgactacagtgatagagagcacctgaaggagcgcttggccaatgagctttcgggactgcccaaggtgcgcctgatccgcgccaacaagagagagggcctggtgcgagcccggctgctgggggcgtctgcggcgaggggcgatgttctgaccttcctggactgtcactgtgagtgccacgaagggtggctggagccgctgctgcagaggatccatgaagaggagtcggcagtggtgtgcccggtgattgatgtgatcgactggaacaccttcgaatacctggggaactccggggagccccagatcggcggtttcgactggaggctggtgttcacgtggcacacagttcctgagagggagaggatacggatgcaatcccccgtcgatgtcatcaggtctccaacaatggctggtgggctgtttgctgtgagtaagaaatattttgaatatctggggtcttatgatacaggaatggaagtttggggaggagaaaacctcgaattttcctttaggatctggcagtgtggtggggttctggaaacacacccatgttcccatgttggccatgttttccccaagcaagctccctactcccgcaacaaggctctggccaacagtgttcgtgcagctgaagtatggatggatgaatttaaagagctctactaccatcgcaacccccgtgcccgcttggaaccttttggggatgtgacagagaggaagcagctccgggacaagctccagtgtaaagacttcaagtggttcttggagactgtgtatccagaactgcatgtgcctgaggacaggcctggcttcttcgggatgctccagaacaaaggactaacagactactgctttgactataaccctcccgatgaaaaccagattgtgggacaccaggtcattctgtacctctgtcatgggatgggccagaatcagtttttcgagtacacgtcccagaaagaaatacgctataacacccaccagcctgagggctgcattgctgtggaagcaggaatggatacccttatcatgcatctctgcgaagaaactgccccagagaatcagaagttcatcttgcaggaggatggatctttatttcacgaacagtccaagaaatgtgtccaggctgcgaggaaggagtcgagtgacagtttcgttccactcttacgagactgcaccaactcggatcatcagaaatggttcttcaaagagcgcatgttatgaagcctcgtgtatcaaggagcccatcgaaggagactgtggagccaggactctgcccaacaaagacttagctaagcagtgaccagaacccaccaaaaactaggctgcattgctttgaagaggcaatcattttgccatttgtgaaagttgtgttggatttagtaaaaatgtgaataagctttgtacttattttgagaactttttaaatgttccaaaataccctattttcaaagggtaatcgtaagatgttaacccttggtatttagaaaattaaaaccttataatatttttctatcaagatgtatattttacagtcgtgccttttactctcattagcaaaaaagataaagattttattttggtatttacaagaattcccaggtacgaagatatctgcatgggtggaaatcaggttcaagcaacgtactttgcattaactgataatacctcagctgcggggttaaagttttcccagtatagagagactgtcactaggaacattgtattgatttattcaggtcattgagatcttctagatgtattttaaaaagaatgctttttggttatgtgttgctaccacagttaacactccataatgttcatgtcagccaaagaggactaaccaaagctgaaatctcagagaacaatttgctttactaagctgagtcaacttgagagcgaacttctaacaatgccgcactgtagtgtggctggttctaccactatgactttaaaacatgtttatatcatttttaatttttatgatacggtagtgtcagggagaaatgtaatgttctatatgaaattcctttttcaagtttgttcattaataacagttattaatttaaatcagcgttagagtttgtgctgctgcaactgctgtgaaaatttctctgagtaattctgatttgtgaatgatcccagaccaaccctgagattttgtcaacctgattaagtcaatatgaatgattaaaaagatgtgagaacactgaaaaaaaaaaaaaaaaaa

SEQ ID NO: 28 - protein, 580 aa, Homo sapiens
  GenBank Accession No. NP_078918
MWGRTARRRCPRELRRGREALLVLLALLALAGLGSVLRAQRGAGAGAAEPGPPRTPRPGRREPVMPRPPVPANALGARGEAVRLQLQGEELRLQEESVRLHQINIYLSDRISLHRRLPERWNPLCKEKKYDYDNLPRTSVIIAFYNEAWSTLLRTVYSVLETSPDILLEEVILVDDYSDREHLKERLANELSGLPKVRLIRANKREGLVRARLLGASAARGDVLTFLDCHCECHEGWLEPLLQRIHEEESAVVCPVIDVIDWNTFEYLGNSGEPQIGGFDWRLVFTWHTVPERERIRMQSPVDVIRSPTMAGGLFAVSKKYFEYLGSYDTGMEVWGGENLEFSFRIWQCGGVLETHPCSHVGHVFPKQAPYSRNKALANSVRAAEVWMDEFKELYYHRNPRARLEPFGDVTERKQLRDKLQCKDFKWFLETVYPELHVPEDRPGFFGMLQNKGLTDYCFDYNPPDENQIVGHQVILYLCHGMGQNQFFEYTSQKEIRYNTHQPEGCIAVEAGMDTLIMHLCEETAPENQKFILQEDGSLFHEQSKKCVQAARKESSDSFVPLLRDCTNSDHQKWFFKERM

SEQ ID NO: 29 - DNA, 3280 bp, Homo sapiens
  GenBank Accession No. NM_004482
gcaggcgcggaagtggggcctcgcccctgccgacgtcgcaggctggagctcacctgggagactccaagtggaagccgagcctcggttctgcctctccaggcaacgcgggaggcccagcgggaaggcaggaggcggcggcggaggaggagctctactgagccgcaactgtggcgacagcaaccggagtcgcagccgccgccacctgcacctggcgcctagcccacgtccagcgcctgcccggccgccgcttcccgccaccctgccctgcccacccgccaggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaaacaaaaacaagatgttggatttaatgctagaagctgtaaacaatattaaggatgccatgccaaaaatgcaaataggagcacctgtcaggcaaaacattgatgctggtgagagaccttgtttgcaaggatattatacagcagcagaattgaagcctgtccttgaccgtccacctcaggattcaaatgcacctggtgcttctggtaaagcattcaagacaaccaatttaagtgttgaagagcaaaaggaaaaggaacgtggggaagctaaacactgctttaatgctttcgcaagtgacaggatttctttgcaccgagatcttggaccagacactcgacctcctgaatgtattgaacaaaaatttaagcgctgccctcccctgcccaccaccagtgtcataatagtttttcataatgaagcgtggtccacgttgcttagaactgtccacagtgtgctctattcttcacctgcaatactgctgaaggaaatcattttggtggatgatgctagtgtagatgagtacttacatgataaactagatgaatatgtaaaacaattttctatagtaaaaatagtcagacaaagagaaagaaaaggtctgatcactgctcggttgctaggagcaacagtcgcaacagctgaaacgctcacatttttagatgctcactgtgagtgtttctatggttggctagaacctctgttggccagaatagctgagaactacacggctgtcgtaagtccagatattgcatccatagatctgaacacgtttgaattcaacaaaccttctccttatggaagtaaccataaccgtggaaattttgactggagtctttcatttggctgggagtcgcttcctgatcatgagaagcaaagaaggaaagatgaaacctacccaattaaaacacccacttttgcaggaggacttttttccatatcaaaagaatattttgagtatattggaagctatgatgaagaaatggaaatctggggaggtgaaaatatagaaatgtctttcagagtatggcaatgtggtgggcagttggagattatgccttgctctgttgttggacatgtttttcgcagcaaaagccctcatagctttccaaaaggcactcaggtgattgctagaaaccaagttcgccttgcagaagtctggatggatgaatacaaggaaatattttataggagaaatacagatgcagcaaaaattgttaaacaaaaagcatttggtgatctttcaaaaagatttgaaataaaacaccgccttcagtgtaaaaattttacatggtatctgaacaacatttatccagaggtgtatgtgccagaccttaatcctgttatatctggatacattaaaagcgttggtcagcctctatgtctggatgttggagaaaacaatcaaggaggcaaaccattaattatgtatacatgtcatggacttgggggaaaccagtactttgaatactctgctcaacatgaaattcggcacaacatccagaaggaattatgtcttcatgctgctcaaggtctcgttcagctgaaggcatgtacctacaaaggtcacaagacagttgtcactggagagcagatatgggagatccagaaggatcaacttctatacaatccattcttaaaaatgtgcctttcagcaaatggagagcatccaagtttagtgtcatgcaacccatcagatccactccaaaaatggatacttagccaaaatgattaagtgttccttaaaattaagttgaaaaaggaaatattctttctcataaaactgtgactaggcatacactgtagtttttgaaaattatgcaaaagcagctaaatgtaacttattccaagtgcatttttcttatttatatctttatgtagcactactacagaaattctgcaagtttctgtttcaaagcacaataactagtaataccaaagactatttcaaaatgtccagatgtaggggaagagatgtttacagtatgatgaaaataattttccaagtaaagtgatgtttgtgtgttttgtacacttagggatatatatatatagctacattcacacactcacaatttaaaatatttcccctagttttttggggggataggaagaaagatttgttactgtatttttttaactacataaaaatagatcaataaatgtcagcattggcctctgtgtacaaaccaagagcttttacagatccagaatttattagtttaaaatgcaggtgaacttttttttgcgtttggtttacttgtctgtcaaatgtttccttaaacatgaaactgaataaggagaagagtatttttaacacttaaatttcttggcaaattttaaaacattttttagtctgtaatacactccacttgaagcacttaagtcttccttaaatgacttttcttaagtaatgatactgtgtgttttcccaaagcacttttaaaaaaatttttataaattactatctgttgaaaaggtgtccttttcctttcttctagtatttttttcttaccaaaattcactaatcttgaatgtttgtgatattaaatttcaaatgcagaatacttgactcatttaaagctaaattttgttactgattcaattataattgtaatggatttttgactttgtaatggattcttttcatcaaaaagccttatttttttatctatgtggaaaacacaataaaaaatcctcaacactattgtaaaaaaaaaaaaaaa

SEQ ID NO: 30 - protein, 633 aa, Homo sapiens
  GenBank Accession No. NP_004473
MAHLKRLVKLHIKRHYHKKFWKLGAVIFFFIIVLVLMQREVSVQYSKEESRMERNMKNKNKMLDLMLEAVNNIKDAMPKMQIGAPVRQNIDAGERPCLQGYYTAAELKPVLDRPPQDSNAPGASGKAFKTTNLSVEEQKEKERGEAKHCFNAFASDRISLHRDLGPDTRPPECIEQKFKRCPPLPTTSVIIVFHNEAWSTLLRTVHSVLYSSPAILLKEIILVDDASVDEYLHDKLDEYVKQFSIVKIVRQRERKGLITARLLGATVATAETLTFLDAHCECFYGWLEPLLARIAENYTAVVSPDIASIDLNTFEFNKPSPYGSNHNRGNFDWSLSFGWESLPDHEKQRRKDETYPIKTPTFAGGLFSISKEYFEYIGSYDEEMEIWGGENIEMSFRVWQCGGQLEIMPCSVVGHVFRSKSPHSFPKGTQVIARNQVRLAEVWMDEYKEIFYRRNTDAAKIVKQKAFGDLSKRFEIKHRLQCKNFTWYLNNIYPEVYVPDLNPVISGYIKSVGQPLCLDVGENNQGGKPLIMYTCHGLGGNQYFEYSAQHEIRHNIQKELCLHAAQGLVQLKACTYKGHKTVVTGEQIWEIQKDQLLYNPFLKMCLSANGEHPSLVSCNPSDPLQKWILSQND

SEQ ID NO: 31 - DNA, 2240 bp, Homo sapiens
  GenBank Accession No. NM_004751
gagtcagagcctcttctctctaagtcacgggaactgcccttgctacttgtgacctgccctttactcagcagtttttgttctgggaagccctgggattctgctaatacctatcactgtaggtgctgaagggaaacagatgaagaacatgacctcaaggagcttcctgtcaatgagaagaccaagctgacgcctggcaaagatattaaagaggagcctgaaactgttccttggacatcttatgaatgtcagaaaataccttttggagggttagaagatcaggggacatggttgttcacatttgctgccacggaacaccgccagtcttcacttggaaacagaatcacgccttgtgaagagatcatccctaagcaggagagaagctactaaaggattgtgtcctcctccaccttccctgtgctcggtctccacctgtctcccattctgtgacgatggttcaatggaagagactctgccagctgcattacttgtgggctctgggctgctatatgctgctggccactgtggctctgaaactttctttcaggttgaagtgtgactctgaccacttgggtctggagtccagggaatctcaaagccagtactgtaggaatatcttgtataatttcctgaaacttccagcaaagaggtctatcaactgttcaggggtcacccgaggggaccaagaggcagtgcttcaggctattctgaataacctggaggtcaagaagaagcgagagcctttcacagacacccactacctctccctcaccagagactgtgagcacttcaaggctgaaaggaagttcatacagttcccactgagcaaagaagaggtggagttccctattgcatactctatggtgattcatgagaagattgaaaactttgaaaggctactgcgagctgtgtatgcccctcagaacatatactgtgtccatgtggatgagaagtccccagaaactttcaaagaggcggtcaaagcaattatttcttgcttcccaaatgtcttcatagccagtaagctggttcgggtggtttatgcctcctggtccagggtgcaagctgacctcaactgcatggaagacttgctccagagctcagtgccgtggaaatacttcctgaatacatgtgggacggactttcctataaagagcaatgcagagatggtccaggctctcaagatgttgaatgggaggaatagcatggagtcagaggtacctcctaagcacaaagaaacccgctggaaatatcactttgaggtagtgagagacacattacacctaaccaacaagaagaaggatcctcccccttataatttaactatgtttacagggaatgcgtacattgtggcttcccgagatttcgtccaacatgttttgaagaaccctaaatcccaacaactgattgaatgggtaaaagacacttatagcccagatgaacacctctgggccacccttcagcgtgcacggtggatgcctggctctgttcccaaccaccccaagtacgacatctcagacatgacttctattgccaggctggtcaagtggcagggtcatgagggagacatcgataagggtgctccttatgctccctgctctggaatccaccagcgggctatctgcgtttatggggctggggacttgaattggatgcttcaaaaccatcacctgttggccaacaagtttgacccaaaggtagatgataatgctcttcagtgcttagaagaatacctacgttataaggccatctatgggactgaactttgagacacactatgagagcgttgctacctgtggggcaagagcatgtacaaacatgctcagaacttgctgggacagtgtgggtgggagaccagggctttgcaattcgtggcatcctttaggataagagggctgctattagagtgtgggtaagtagatcttttgccttgcaaattgctgcctgggtgaatgctgcttgttctctcacccctaaccctagtagttcctccactaactttctcactaagtgagaatgagaactgctgtgatagggagagtgaaggagggatatgtggtagagcacttgatttcagttgaatgcctgctggtagcttttccattctgtggagctgccgttcctaataattccaggtttggtagcgtggaggagaactttgatggaaagagaaccttcccttctgtactgttaacttaaaaataaatagctcctgattcaaagtaaaaaaaaaaaaaaaaaaa

SEQ ID NO: 32 - protein, 438 aa, Homo sapiens
  GenBank Accession No. NP_004742
MVQWKRLCQLHYLWALGCYMLLATVALKLSFRLKCDSDHLGLESRESQSQYCRNILYNFLKLPAKRSINCSGVTRGDQEAVLQAILNNLEVKKKREPFTDTHYLSLTRDCEHFKAERKFIQFPLSKEEVEFPIAYSMVIHEKIENFERLLRAVYAPQNIYCVHVDEKSPETFKEAVKAIISCFPNVFIASKLVRVVYASWSRVQADLNCMEDLLQSSVPWKYFLNTCGTDFPIKSNAEMVQALKMLNGRNSMESEVPPKHKETRWKYHFEVVRDTLHLTNKKKDPPPYNLTMFTGNAYIVASRDFVQHVLKNPKSQQLIEWVKDTYSPDEHLWATLQRARWMPGSVPNHPKYDISDMTSIARLVKWQGHEGDIDKGAPYAPCSGIHQRAICVYGAGDLNWMLQNHHLLANKFDPKVDDNALQCLEEYLRYKAIYGTEL

SEQ ID NO: 33 - DNA, 2910 bp, Homo sapiens
  GenBank Accession No. NM_006302
acttccggcgggaggcggaggcggaggcgcaggcgctggctggcaggtgtcgctaaccggacggtggtcgccagggcgagaggcgggagccggagaggtgaggcaggacccgggctccactgccgcctctccgagctcttgtgacgcggacctcagtgccaggatggctcggggcgagcggcggcgccgcgcagtgccggcagagggagtgcggacagccgagagggcggctcggggaggccccgggcgacgggacggccggggcggcgggccgcgtagcacggctggaggagtggctctggccgtcgtggtcctgtctttggccctgggtatgtcggggcgctgggtgctggcgtggtaccgtgcgcggcgggcggtcacgctgcactccgcgcctcctgtgttgcctgccgactcctccagccccgccgtggccccggacctcttctggggaacctaccgccctcacgtctacttcggcatgaagacccgcagcccgaagcccctcctcaccggactgatgtgggcgcagcagggcaccaccccggggactcctaagctcaggcacacgtgtgagcagggggacggtgtgggtccctatggctgggagttccacgacggcctctccttcgggcgccaacacatccaggatggggccttaaggctcaccactgagttcgtcaagaggcctgggggtcagcacggaggggactggagctggagagtgactgtagagcctcaggactcaggtacttctgccctccctttggtctccctgttcttctatgtggtgacagatggcaaggaagtcctactaccagaggttggggccaaggggcagttgaagtttatcagtgggcacaccagtgaacttggtgacttccgctttacacttttgccaccaaccagtccaggggatacagcccccaagtatggcagctacaatgtcttctggacctccaacccaggactgcccctgctgacagagatggtaaagagtcgcctaaatagctggtttcagcatcggcccccaggggccccccctgaacgctacctcggcttgccaggatccctgaagtgggaggacagaggtccaagtgggcaagggcaggggcagttcttgatacagcaggtgaccctgaaaattcccatttccatagagtttgtgtttgaatcaggcagtgcccaggcaggaggaaatcaagccctgccaagactggcaggcagtctactgacccaggccctggagagccatgctgaaggctttagagagcgctttgagaagaccttccagctgaaggagaagggcctgagctctggcgagcaggttttgggtcaggctgccctcagcggcctccttggtggaattggctacttctacggacaagggctggtattgccagacatcggggtggaagggtctgagcagaaggtggacccagccctctttccacccgtacctctttttacagcagtgccctcccggtcattcttcccacgaggcttcctttgggatgaaggctttcaccagctggtggttcagcggtgggatccctccctcacccgggaagcccttggccactggctggggctgctaaatgctgatggctggattgggagggagcagatactgggggatgaggcccgagcccgggtgcctccagaattcctagtacaacgagcagtccacgccaaccccccaaccctacttttgcctgtagcccatatgctagaggttggtgaccctgacgacttggctttcctccgaaaggccttgccccgcctgcatgcctggttttcctggctccatcagagccaggcaggcccactgccactatcttaccgctggcggggacgggaccctgccttaccaaccttactgaaccccaagaccctaccctctgggctggatgactacccccgggcttcacacccttcagtaaccgagcggcacctggacctgcgatgttgggtggcactgggtgcccgtgtgctgacgcggctggcagagcatctgggtgaggctgaggtagctgctgagctgggcccactggctgcctcactggaggcagcagagagcctggatgagctgcactgggccccagagctaggagtctttgcagactttgggaaccacacaaaagcagtacagctgaagcccaggccccctcaggggctcgttcgggtggtgggtcggccccaacctcaactgcagtatgtagatgctcttggctatgtcagtctttttcccttgctgctgcgactgctggaccccacctcatcccgccttgggcccctgctggacattctagccgacagccgccatctctggagcccctttggtttacgctcccttgcagcctccagctccttttatggccagcgcaattcagagcatgatcccccctactggcggggtgctgtgtggctcaatgtcaactacctggctttgggagcactccaccactatgggcatctggagggtcctcaccaggctcgggctgccaaactccacggtgagctccgtgccaacgtggtaggcaatgtatggcgccagtaccaggctacaggctttctttgggagcagtacagtgaccgcgatgggcgaggcatgggctgccgccctttccacggctggaccagccttgtcttactggccatggctgaagactactgaagggagggagaggaggggagccaagacactcatgccactctggctctgaagggacaaaggcttctggcttttgcccccagccccttggataccagtaattcaaaccttcctcatttcatctcaggtgtctccttgctgtcatcccacatagccctggggtgaatgtgaatccagagtctatttttctaaataaattggaaaaaacattttgaactctaaaaaaaaaaaaaaaa

SEQ ID NO: 34 - protein, 837 aa, Homo sapiens
  GenBank Accession No. NP_006293
MARGERRRRAVPAEGVRTAERAARGGPGRRDGRGGGPRSTAGGVALAVVVLSLALGMSGRWVLAWYRARRAVTLHSAPPVLPADSSSPAVAPDLFWGTYRPHVYFGMKTRSPKPLLTGLMWAQQGTTPGTPKLRHTCEQGDGVGPYGWEFHDGLSFGRQHIQDGALRLTTEFVKRPGGQHGGDWSWRVTVEPQDSGTSALPLVSLFFYVVTDGKEVLLPEVGAKGQLKFISGHTSELGDFRFTLLPPTSPGDTAPKYGSYNVFWTSNPGLPLLTEMVKSRLNSWFQHRPPGAPPERYLGLPGSLKWEDRGPSGQGQGQFLIQQVTLKIPISIEFVFESGSAQAGGNQALPRLAGSLLTQALESHAEGFRERFEKTFQLKEKGLSSGEQVLGQAALSGLLGGIGYFYGQGLVLPDIGVEGSEQKVDPALFPPVPLFTAVPSRSFFPRGFLWDEGFHQLVVQRWDPSLTREALGHWLGLLNADGWIGREQILGDEARARVPPEFLVQRAVHANPPTLLLPVAHMLEVGDPDDLAFLRKALPRLHAWFSWLHQSQAGPLPLSYRWRGRDPALPTLLNPKTLPSGLDDYPRASHPSVTERHLDLRCWVALGARVLTRLAEHLGEAEVAAELGPLAASLEAAESLDELHWAPELGVFADFGNHTKAVQLKPRPPQGLVRVVGRPQPQLQYVDALGYVSLFPLLLRLLDPTSSRLGPLLDILADSRHLWSPFGLRSLAASSSFYGQRNSEHDPPYWRGAVWLNVNYLALGALHHYGHLEGPHQARAAKLHGELRANVVGNVWRQYQATGFLWEQYSDRDGRGMGCRPFHGWTSLVLLAMAEDY

SEQ ID NO: 35 - DNA, 1965 bp, Homo sapiens
  GenBank Accession No. NM_005114
aacgcccgcctgcaaggtcctctgcgccctggcagccaggagtcgccgccacgaccgccgggtctcagtgggtgcctgcgccttctccccgcccgcctgccccgggccatccagaaacttgctctacccgccgcgggtgctcggcagtgctgcccatggcccagcccaggagcctatttagggcgccggacgggctggacagaggcgcggctcagtaattgaaggcctgaaacgcccatgtgccactgactaggaggcttccctgctgcggcacttcatgacccagcggcgcgcggcccagtgaagccaccgtggtgtccagcatggccgcgctgctcctgggcgcggtgctgctggtggcccagccccagctagtgccttcccgccccgccgagctaggccagcaggagcttctgcggaaagcggggaccctccaggatgacgtccgcgatggcgtggccccaaacggctctgcccagcagttgccgcagaccatcatcatcggcgtgcgcaagggcggcacgcgcgcactgctggagatgctcagcctgcaccccgacgtggcggccgcggagaacgaggtccacttcttcgactgggaggagcattacagccacggcttgggctggtacctcagccagatgcccttctcctggccacaccagctcacagtggagaagacccccgcgtatttcacgtcgcccaaagtgcctgagcgagtctacagcatgaacccgtccatccggctgctgctcatcctgcgagacccgtcggagcgcgtgctatctgactacacccaagtgttctacaaccacatgcagaagcacaagccctacccgtccatcgaggagttcctggtgcgcgatggcaggctcaatgtggactacaaggccctcaaccgcagcctctaccacgtgcacatgcagaactggctgcgctttttcccgctgcgccacatccacattgtggacggcgaccgcctcatcagggaccccttccctgagatccaaaaggtcgagaggttcctaaagctgtcgccgcagatcaatgcttcgaacttctactttaacaaaaccaagggcttttactgcctgcgggacagcggccgggaccgctgcttacatgagtccaaaggccgggcgcacccccaagtcgatcccaaactactcaataaactgcacgaatattttcatgagccaaataagaagttcttcgagcttgttggcagaacatttgactggcactgatttgcaataagctaagctcagaaactttcctactgtaagttctggtgtacatctgaggggaaaaagaattttaaaaaagcatttaaggtataatttatttgtaaaatccataaagtacttctgtacagtattagattcacaattgccatatatactagttatatttttctacttgttaaatggagggcattttgtattgtttttcatggttgttaacattgtgtaatatgtctctatatgaaggaactaaactatttcactgaaaaaaaaaaaaagattttttctggagacgctatgtttttttgaatataattaacttgcccccaactcaaaatagctgtctgtgttgcaatcattgcaaaatctaaattcttttgttacttaaaaaaacatgtttttcatggctattacaatcctctctctcccctctcctttctgcattgctctttttaatttttaatgtctcattgtgatcatcagatttatttttacttggattgtaagatttatctcctcggcgattccttgtcatttttggaggtcacagttttactcattcccatgtgtaaacttcaagtaaacaaagcaatattcaggatggagaagcagttagtgactggctagaggtctcttgggatccatcttgacctcaaagaatatttgcacatgcttctgatctcagcagttataataaagaggattaaacccttggccttca

SEQ ID NO: 36 - protein, 307 aa, Homo sapiens
  GenBank Accession No. NP_005105
MAALLLGAVLLVAQPQLVPSRPAELGQQELLRKAGTLQDDVRDGVAPNGSAQQLPQTIIIGVRKGGTRALLEMLSLHPDVAAAENEVHFFDWEEHYSHGLGWYLSQMPFSWPHQLTVEKTPAYFTSPKVPERVYSMNPSIRLLLILRDPSERVLSDYTQVFYNHMQKHKPYPSIEEFLVRDGRLNVDYKALNRSLYHVHMQNWLRFFPLRHIHIVDGDRLIRDPFPEIQKVERFLKLSPQINASNFYFNKTKGFYCLRDSGRDRCLHESKGRAHPQVDPKLLNKLHEYFHEPNKKFFELVGRTFDWH

SEQ ID NO: 37 - DNA, 8382 bp, Homo sapiens
  GenBank Accession No. NM_012214
cgcagcggcggcggcagcggcggcggcggctacagcagctccgccggcagccgcgggagcacggcgacgccagcggcgggaagggaaaaggccgaggcatcagcgtgtgaagaccgcaaagacgatcccgagtacagttgtgaacagcattgctgctaggctcctcctgcagatcatctgaaatgaacctctcttattgatttttattggcctagagccaggagtactgcattcagttgactttcagggtaaaaagaaaacagtcctggttgttgtcatcataaacatatggaccagtgtgatggtgaaatgagatgaggctccgcaatggaactgtagccactgctttagcatttatcacttccttccttactttgtcttggtatactacatggcaaaatgggaaagaaaaactgattgcttatcaacgagaattccttgctttgaaagaacgtcttcgaatagctgaacacagaatctcacagcgctcttctgaattaaatacgattgtgcaacagttcaagcgtgtaggagcagaaacaaatggaagtaaggatgcgttgaataagttttcagataataccctaaagctgttaaaggagttaacaagcaaaaaatctcttcaagtgccaagtatttattatcatttgcctcatttattgaaaaatgaaggaagtcttcaacctgctgtacagattggcaacggaagaacaggagtttcaatagtcatgggcattcccacagtgaagagagaagttaaatcttacctcatagaaactcttcattcccttattgataacctgtatcctgaagagaagttggactgtgttatagtagtcttcataggagagacagatattgattatgtacatggtgttgtagccaacctggagaaagaattttctaaagaaatcagttctggcttggtggaagtcatatcaccccctgaaagctattatcctgacttgacaaacctaaaggagacatttggagactccaaagaaagagtaagatggagaacaaagcaaaacctagattactgttttctaatgatgtatgctcaagaaaagggcatatattacattcagcttgaagatgatattattgtcaaacaaaattattttaataccataaaaaattttgcacttcaactttcttctgaggaatggatgattctagagttttcccagctgggcttcattggtaaaatgtttcaagcgccggatcttactctgattgtagaattcatattcatgttttacaaggagaaacccattgattggctcctggaccatattctctgggtgaaagtctgcaaccctgaaaaagatgcaaaacattgtgatagacagaaagcaaatctgcgaattcgcttcagaccttcccttttccaacatgttggtctgcactcatcactatcaggaaaaatccaaaaactcacggataaagattatatgaaaccattacttcttaaaatccatgtaaacccacctgcggaggtatctacttccttgaaggtctaccaagggcatacgctggagaaaacttacatgggagaggatttcttctgggctatcacaccgatagctggagactacatcttgtttaaatttgataaaccagtcaatgtagaaagttatttgttccatagcggcaaccaagaacatcctggagatattctgctaaacacaactgtggaagttttgccttttaagagtgaaggtttggaaataagcaaagaaaccaaagacaaacgattagaagatggctatttcagaataggaaaatttgagaatggtgttgcagaaggaatggtggatccaagtctcaatcccatttcagcctttcgactttcagttattcagaattctgctgtttgggccattcttaatgagattcatattaaaaaagccaccaactgatcatctgagaaaccaacacattttttcctgtgaatttgttaattaaagatagttaagcatgtatcttttttttatttctacttgaacactacctcttgtgaagtctactgtagataagacgattgtcatttccacttggaaagtgaatctcccataataattgtatttgtttgaaactaagctgtcctcagattttaacttgactcaaacatttttcaattatgacagcctgttaatatgacttgtactattttggtattatactaatacataagagttgtacatattgttacattctttaaatttgagaaaaactaatgttacatacattttatgaagggggtacttttgaggttcacttattttactattatagaccctcttttatagattatcagggattatatatataaatatataaatatacataaaaatgttatggaattaatttattagaaacacttaagaagtacatatttttgtgcagtagatttttgaatcgatactttttttgaaaaccagtttccttgcttttttaagttctttctatatttttctttggaaatgcaaacattacaaaccaatgccatttttcaaatgcactgccatttaagattgattatagatggatttcttaattgaagtacttttataatcacagtgactgaacaaaatattttcaaagacatttgtcattccttaaagccaagattttaaagactaatgtccttcctgagggttactttactatactgtgtatggtgtatagccacagaaagtcagtctgataaattttcaatgtgtaagtgtgatgcattcaacccagattattgtagacttaacttattatatttcctctgatatgtaaaatgacaaactcttctttcctttttaatctttgtctttaatccatgaattaggtgcattatctgctgttgattcttttatatctgcactcattttatgacgtcagacaaaatgttttctaggtgttgctattgtatgagtcataattggtataattttaaagaaaattgtaatattgttttttggtgaaatatattattagtagtatattttccaaaatgattttattgtagtatgaactgataagtgagtcccgtgtccaagagactgtatttattactcttaaacacgctattccaaatgatattactactataaacaaagaatattaccggtctcagcaatcagtgatctttataaaagtacttttaaaaaatgatgaattatcaccaggcgctgtggctcacgcctgtaatcccagcactttgggaggccgaggcgggcggatcacgaggtcaggagatcaagaccatcctggctaacacggtgaaaccctgtctctactaaaaatacaaaaaattagccaggcgtggtggcaggtgcctgtaatcccagctacttgggaggctgaggcaggagaatggcgtgaacccaggaggcagagctggcagtgagctgagatcgcaccactgcactccagcctgggcgacacagctagactccgtctcaaaaaaaaaaaaagatgaagtatcaacatcagttcccagccagtctgcttggacacactggggtgccacaagtgggttgcaggttggttgcagacgggcagagatggattctgctgagctttcagagtgaccactggctggggcctagcgctggggcaaggttccagctggctgcctctagcctggaggagcttcatctagttacccaatgtgctgaaccaacagcatgaaatagcatcatttcctgtgctgtgttacaaagtgcaaacgtttggaaacactgatacagtacaattatttccatcactccatgttgttataatttttagttacttttcttgattgaaaagtcaatcacattgccaaaaatgatttttatgtcagttaaaggccagttgaaatttttttattaggatgttttaaatttacttttcactttcttgaatttttttcttctcaaatttccttggcccagtgcccatgagcaaatttcattcaaaaacaggaataaccttttgtcataaaattttggcaccagcttggtatactaaattactgcaaagataactgagtaccagaagtaaaaatctctgcaggtgggcttaggagtactcttgggtccctggttcctcagttgccaactctggtttcatgaagaaagaccatgctctgaaaatctagggaggagaaagttattgcagcacctggtgtgatttgttacaacttctttaaagacagcctgcctggctagctttttcctgttttcatgcagtttgccctcccagcattggtccacctgttgttcccaagaaactcattcttgttcccaagactccttttagccaaatctttcctatcattccaggacttttttgtgcttctctccccatgaatctacccgtgcctagggtgtgtgccaggcacgtggcaggtggccagtcagcatctggatgtgagaccaattattccagcctgccctcctctttctctttttatcattttgtattatttttgagacagggtctcgctttgttgcccaggctggagtgcagtggtgctctcatagctcactgcagcctcgatctctggcctcaagcaatcctcctgcctcagcctcccaaagtgctgggattataggtgtgtgccaccatgtccagccccctttctctctcttaactccctctccctgctgtcgttgccatactcttgcatacacaatcggttgtctagtttttgattgtttgtgtgtatggtgtgtgctgtctctctgaccagatttcaggttcctgaggcgagcctgcagctcatactgctcatctgtcctctcctatggtgggtgctcagggcctctcactgttagttactccctcctttctgcccagttctgcactcaactagtagaagcagccatcctttccccaagcaggaaattgtagtggtcgcccttaagagcagtgtgagggcagaagattaagggaggggaagagtccctggaactggaagaaggtaaatactttgccttgagagggcgccgaatcattttaccaaaatagtaaatggaaaaagtgtcaaaggttgggactagttttaaaaacacatatagccagtagacacatgggggctgtttaaataaaaacatttttttacccggttctgccatcacacacactagtgacattccaagtactcagtggccatgtggagctagtggccaccacacttgacaccacggatgcagaacttttccatcactgcagaaagctctgttgaacagtactgtgtccagagtgctaattatgaacagcttagaaaccacaattaatacattctcatgaggttaaaagcagacatgggaatagaacataatgcaaatgatgatgaatattttgggtgagaagagaaagctgaggacccatttctaggattctaagatgtaagatttcttaagttctttatcttagtctcatgcattctccacatcacgcgctgtaccatactgtgtagtcagaacagacagtgtgattgaaaagctttggaaaaagttaacacaaaggattatttagcacataggctgtagatacgtatgtgtgtatttgttcaacaattggagatggttgaatacccttgaacaaagtgtgtatcttctcaaatcagtggttgcactagtcaataattagaaggtgttgttatttttaaaactataagcaaaattatgaaggcctttaaaaaatctatcataataatgaaaaagaggttgtctcccaacagtgctgtccctcaaagaaaagactggttatgtggaaacagcacgtttggagagattattctagtgaataacagtgtatatttgtggtaggcaaatttctaagaatgacccctactgacacccccaccaatgaccttgtataatatcctcccactttgagcatgggtggaacctgtttgatccatgattatatcatgttatgtagcaaaaggaagactgtctgggggtggctaatcaaatcttgtgactcctttaaaagcagagagttttctcgggctggtggcagaagtcaagagacaaagcagaaggacctcaggcaccattgctgttttaaggtagagggggctgcatgagaaggaatgcacatggctttgaggagctgagagaggccttggctaacagcaaaggagctgggaactgcagtcctacagccacgggaactgaattcagcccataagctcattcataggcttggaaaggcattcatctccagtctccagataagacccagcctggccaacactttgaatccagccttgtgagaccctaagccgagaactcacttaagcctgcttggacttctgacctacagaactatgagataataaatcagtggtgttttaagctgctaaatttgtggcaatttgttatgtaggaataggaaatgaatacagtattttaaaagaggtaaagaggaaatcttcatacttgattccctgtagtatgctggatatttcttggtaaatgcatgaataaagtctttagtagcaagtcatgtacctggaccttgttggggatgttctcgccagagatctcaattagtcttcattggacgtttgttggcaaagttgcagcatcttactgagtagcgtttggtaaaggaactgctagaatgagactataggaataggactgaaacagtgtgtaagggatcttttttatttctagaagaggtgttactttatactgatttagactgctctgagcctgtcagaagtaaattcaagaatgattaacagtggtattttagatacattaagagcaaaaataacctttgccttgtagagatcagataatctgtgtatcgagggatttaattttttttaaccaaaacttagtttctctttttatcatctagcacagatcaaatcctgtatgggccagccaaatgtttgtagtttgagaatgttttgcaaatacctctctgcttccaagccattaatagctaatgaagttttattttggtttgtccattaatttttctgcttatttttactgtattgccatgtccttgatacgagacaagtagaactaaaagagagaaaatgagaggttaagactgtcagaagatgagaaatgtgagtcataaccataccttagtgttttaagggaactttatccagtccaatccctttatagaaaaggaacttttccaagttatgttgcagtatttatagtgtgtaaaattttgtttgactttggtagttgtgcattttaaattatgaatcttatatgctacgataactagtatgcttactttctttaatgcatgtgatcatacaatgctaaaaaggtattttttaaagacccaaccaaactgaggattttgttatacatatctgtatcaacacctatatataaactcttcttcttacctgaaacactccttcacccggtttgggcactaactagatcattttcaaaggaacaaacaggaaggagcaagctggcactccagggtgcatctgagctgagaatttagaagacctcattcaagaaagtaaactgagcattgatgggaaagcactttgcgcgaagtaacattcccactgttaatgttgcagtcaaaattgtggaaaaaaaaaagtggtgctaaaattgttctgaaatgaagattgtttgttgtggggaatattttaatactcttggactttagggaggctattttatgtgtcacttgctcctagttgtttcattgtattagtaattagcaaactgtcctggaaccaagggtttggtacttttgcctgattagcattccattatttatttgaaatgctcagtgtttgctcaaatttggtgaaaatatcttttgaagacatattctctgagccttaaaaatggctgctatcgacagtactgtaagatgcactgccagtagatttgatacttttcatttcagtgtaggcagtaatgttttctaagaaagatttagaaatcagcaaagtgtaacaattgtgtttcatttatggaatggaaaaactgaagtgtcccattcagaacactttggaaaggttgtctgcattaggggatgtttctggaagcatcccttagagaagctgcctgaggaatctccttgccaggttgtaccagatttttttttttcttaaatgtattgtatatattttccttaaaatgtcttcattggctgaatgattcctatccgtagtaatattttaggtacttgttggatttttaaaggaagattatttattttcagatttgctgctataattgaaaacctagtaactggtcctgttgattgtgccttcatcactgtttctctgtgccacgaccgttcatgtgtatttgaaataaagaagtttaaaaagccatgttgaattcaagattccttctaataaaaataggtgaaacttaa

SEQ ID NO: 38 - protein, 535 aa, Homo sapiens
  GenBank Accession No. NP_036346
MRLRNGTVATALAFITSFLTLSWYTTWQNGKEKLIAYQREFLALKERLRIAEHRISQRSSELNTIVQQFKRVGAETNGSKDALNKFSDNTLKLLKELTSKKSLQVPSIYYHLPHLLKNEGSLQPAVQIGNGRTGVSIVMGIPTVKREVKSYLIETLHSLIDNLYPEEKLDCVIVVFIGETDIDYVHGVVANLEKEFSKEISSGLVEVISPPESYYPDLTNLKETFGDSKERVRWRTKQNLDYCFLMMYAQEKGIYYIQLEDDIIVKQNYFNTIKNFALQLSSEEWMILEFSQLGFIGKMFQAPDLTLIVEFIFMFYKEKPIDWLLDHILWVKVCNPEKDAKHCDRQKANLRIRFRPSLFQHVGLHSSLSGKIQKLTDKDYMKPLLLKIHVNPPAEVSTSLKVYQGHTLEKTYMGEDFFWAITPIAGDYILFKFDKPVNVESYLFHSGNQEHPGDILLNTTVEVLPFKSEGLEISKETKDKRLEDGYFRIGKFENGVAEGMVDPSLNPISAFRLSVIQNSAVWAILNEIHIKKATN

SEQ ID NO: 39 - DNA, 8163 bp, Homo sapiens
  GenBank Accession No. NM_002410
cagcagaatggaagtgaggaaaggcaaccagctgacacaggagccagagtgagaccagcagactctcacactcaacctacaccatgaatttgtgtctatcttctacgcgttaagagccaaggacaggtgaagttgccagagagcaatggctctcttcactccgtggaagttgtcctctcagaagctgggctttttcctggtgacttttggcttcatttggggtatgatgcttctgcactttaccatccagcagcgaactcagcctgaaagcagctccatgctgcgcgagcagatcctggacctcagcaaaaggtacatcaaggcactggcagaagaaaacaggaatgtggtggatgggccatacgctggagtcatgacagcttatgatctgaagaaaacccttgctgtgttattagataacattttgcagcgcattggcaagttggagtcgaaggtggacaatcttgttgtcaatggcaccggaacaaactcaaccaactccactacagctgttcccagcttggttgcacttgagaaaattaatgtggcagatatcattaacggagctcaagaaaaatgtgtattgcctcctatggacggctaccctcactgtgagggaaagatcaagtggatgaaagacatgtggcgttcagatccctgctacgcagactatggagtggatggatccacctgctctttttttatttacctcagtgaggttgaaaattggtgtcctcatttaccttggagagcaaaaaatccctacgaagaagctgatcataattcattggcggaaattcgtacagattttaatattctctacagtatgatgaaaaagcatgaagaattccggtggatgagactacggatccggcgaatggctgacgcatggatccaagcaatcaagtccctggcagaaaagcagaaccttgaaaagagaaagcggaagaaagtcctcgttcacctgggactcctgaccaaggaatctggatttaagattgcagagacagctttcagtggtggccctcttggtgaattagttcaatggagtgatttaattacatctctgtacttactgggccatgacattaggatttcagcttcactggctgagctcaaggaaatcatgaagaaggttgtaggaaaccgatctggctgcccaactgtaggagacagaattgttgagctcatttacattgatattgtaggacttgctcaattcaagaaaactcttggaccatcctgggttcattaccagtgcatgctccgagtccttgattcatttggtactgaacccgaatttaatcatgcaaattatgcccaatcgaaaggccacaagaccccttggggaaaatggaatctgaaccctcagcagttttataccatgttccctcataccccagacaacagctttctggggtttgtggttgagcagcacctgaactccagtgatatccaccacattaatgaaatcaaaaggcagaaccagtcccttgtgtatggcaaagtggatagcttctggaagaataagaagatctacttggacattattcacacatacatggaagtgcatgcaactgtttatggctccagcacaaagaatattcccagttacgtgaaaaaccatggtatcctcagtggacgggacctgcagttccttcttcgagaaaccaagttgtttgttggacttgggttcccttacgagggcccagctcccctggaagctatcgcaaatggatgtgcttttctgaatcccaagttcaacccacccaaaagcagcaaaaacacagactttttcattggcaagccaactctgagagagctgacatcccagcatccttacgctgaagttttcatcgggcggccacatgtgtggactgttgacctcaacaatcaggaggaagtagaggatgcagtgaaagcaattttaaatcagaagattgagccatacatgccatatgaatttacgtgcgaggggatgctacagagaatcaatgctttcattgaaaaacaggacttctgccatgggcaagtgatgtggccacccctcagcgccctacaggtcaagcttgctgagcccgggcagtcctgcaagcaggtgtgccaggagagccagctcatctgcgagccttctttcttccagcacctcaacaaggacaaggacatgctgaagtacaaggtgacctgccaaagctcagagctggccaaggacatcctggtgccctcctttgaccctaagaataagcactgtgtgtttcaaggtgacctcctgctcttcagctgtgcaggcgcccaccccaggcaccagagggtctgcccctgccgggacttcatcaagggccaggtggctctctgcaaagactgcctatagcagctacctgctcagccctgcaccatgctgctggggaagacagtggccccagccccgtcaggcagggccagggacagaagtcatgcagggactctggcaagagcctgaactttttcgtagaaggttctgaattggcattgcccttgctgcactccgagcaacccagtggagtcttcaccaaaacaaaacaagagcgtatgtcaggccaggagcctggcttgtccctggcacaacatcatttctgtttctcaaggagcaactgtgggaagactgtcactgcagctgctccagggcaaaagaaagtctcaagagtcctttaaaacaaaacaggaggaattgagctgatgggaaagaactctgaatgggaatattcctaaacccattaacttatttattcgggtgggagggaggggaccgcgggagggagaggagggattgatcacaggcttcttttatttccactgttaatcatccaccttcactatactgttgttctgtctgctttgggcagggtgcaggagagagaccgtgtgccgtggggctggtggcctgctcagggacagccatggggacctggcagctcaaaacagatggcagcagaacaaaagaaacttttgctttggaagcacagccaaactccccagggcatcgtcatagatggcacctagagcatgggctgcctcagtcagggggacgtgcctgtgttgtccagagagcccagccagggacgaaaaaggagatgaggcccctttcctccatgtccccatgcccagacacataccttggccgtaatttcttttagaatccctttgggaaggaaatacaggattgagggattttggagtttctggtaaactcaccctccctccagccccgctatgaggaggaaagtagagatgaaagactcacgctgttcatggacttggagaggattatctttgagccaagatttggacaggagtgaagtcggtccttaagaatttgtggcgcgaccggagctgggctcctgacaggtgggcttgtgttgtgtcccctctgatggcaccaaagtccagggaagggggctcttgatgtctgctgggggagtgggggcagctcaggatgaatgcagtgccctgtcctggctactcacctgagggtgtagctcgcaaaggtgggaatctggtgctggcttttccttcaggcaggatcactctgacttgttgagtaatcagtcatcaggttggcctggtcagacacactggaccccaccttccaaaccctggacccccccatgctctgcctttgtataagttcccaccccactgaatcattgctgccatgctctgtacaagtttgtaagtttctgaaaagcccctgacatctccatgctgatgcaagtgagaccccttctgcctaatgtgagcggttggcgtcctccacttggcctctgctgggcgcctcagtcgctcaatgatgtgctctgtgccggggcttccaagcacccttcctgctaacagagggcggcccagtggagcctccgctgggcagaactgatgggcaaggcgtaatggctggtagctttcagaatgtgagggaaaggaagaattccgcttcatggggactagagttagtgtggggcctttaagtctgggaagttacattctgcttctttctcaattgctacacaaatgtgcagccagccttttttcttaggcccactgagatccctgctcagtgcgtctcaattgtatctccagtctaagaggagggtggggggcacccggggcctcctccactccttaggtggcccccaagcacatctgccaggtagagtaccatggggaggcctctgccctgagcatcatcacaggggcgcctccagacctggctgagaatagcctctgcttgggcctaggaagaagggcagaagtccaaaggaaaccttggtgagtgagtgtgtgtgtgtgtgtgtgtgtgtgtgtgtgtgtgtgtgtgtgtgtgtatgagcctgtgcatttcttttaagcaagggcagtttcctgcagtaggagggcagatgactggcatccttgctgtaaggaagagctttttccttgtgaatgggcctcttggctgtaccctagggtgtgggaatttgctagagttccctgacctgcaatccctgggccagtgccgccctctcctgggctcttccaggagcattgaacactgaggatgtcaatgcaagtatctgaccaacagggggagcctgcaggccgagcaaagtttaacccacttagccactgctacttaagcaaggaagctgaaaggtaaccttagccctgccttgtgttccaaaagctgcaaggatcatttgctggctgtccctaagttcaaggcctccctaccttccccttcttttccaagtcacaacccgccctgcccgggccagacagcccagaagaacacttttctgccatttaaaaatccctctttcatcccccccagtccagtattgagtggaagtgcgccggagttccactgacagggcagctgctcttggagcaaacaagcccacactccagttgtttagggcattatctgaagagtcagtgacccctgaatgtgtactggctcccaggcctcctcagacttggcccaggtctagtcagtgatcctggagaggaaactggggagggggcttccaactgccctgcatggaagaggagaggaaggtgcccctgtgtgggctggaagcctgcggaggttttgccattgctgatcttgatagaatcctaaaccgatttatagctgataacagttccatggggagagaaatcctaagttatgattaatgtttttccccgctataatatcttgcctgtttttttggattattttccccattgtgatcctaagctcttaaaaaacttgagggaaaacattcatctaatttactaaaagagaaagctttccattgaaaggtagatactttgaggagtaaaaagacttctttgaatgctggtaaacaccgcatttattttgtgtatgcagtttgatttgcacatgtataaatggagatgcttttcatttttgtttggactgggtttgtgtcactgctcattacagtttgcttttttgtgtgtttgctgtgcgtttggagatattagtcagtttctttagtgatatttgtttccttgatgtgccttttcgtttttctttggggtttttggaatccggatgctgttgaagggcaatagcagactcctccagctaagagacaggacatgttcttgagccactgtagctgttgaagctggacaccagacgctccctataacccccccgccaggccatagcgtgtatgcatgtgcacttccacccacagaggagggtgtgaagccttgagaacctcaagaaagggctggattctgccatacctttgggtctaccttgggactgctggttgccaacgtgtcaaccagcctgtgttccctgccacccacgcacttgctgaggtgtggctgaggcagaatcatgtgaatgggtgcatccaaggagttcagggccctgcttggagaagaaatactttagcatcatgaaagggaaagaacgtgcaccccttttttgtttctttagtgaatgcaagatttaataaaagtgaataatgagcttcccctttgggagtggagcccagtgcagctcactgacagggttgacatcagtatgatgtgttggactgaaactgtatgtctgtaggtaggtgtgtgccttttagggcagaccacggtggccaccccatttctccaaggtggtttacctagcttgtgtatattagacattgccaccctcacctctggccaaaaattcttgatttaaaaagaaaagtctattttgttaacgacaggctctgttgtatgtgttactatcccaagcctggattattttatttatttaaaagtattttaatttccatattggctttattctaatcccatccatccctgtggagctgcagagcatcttcatgtgagtagacggatggacataaatagattcatgctcatttaggaagctgggagtttcgtgaagctgagggtgagttcctgtgattcttgttcgcttcaacaaaaagtgggagaccaagtttttatagcaaaagaccaaattagctgtagagtcttgaatgcagaaaaaaattaccctagctttcttagcacttagggttttgtgaggattcagtgtttagcacagtgcttggcacatagtaagccctagtaaatgttaaatattgttattagtgtttcgtaaaacttgagaaatagagctgagctcattcccttcctgttgattcaaaaataatacctacatgaaaacatgattccaagttgattgaatgttgtaggaattactggtttagagtagcccagttctcggcctaccctgctggttgggatcttactgtattcttgaatgcactggtttgaaaatatgccagacttcagcccccaaggaaacaaggctgcaagaatttatgaactccagctggaaaaggtaaaggtgacctttggctagccacatactggaccttaccccactgacgtctttcagaacattccaagggttttcctcaaggaacatttttgagctagaaattaaaatgggttctctggcagactgcaccccttgagtcaaagttaacagtattcctttgaatgcaataatagaggcttttctgcgttaagggagaaggaatgaccaattgaacttacacattccccaggcaggtccctttgccggcccctacaggctggggtggcccctcctgtcctcagggatcagactcccagactggttagttctgcatgtttccatcaaattaaaggttattccctggccgcctcctggagaaaaccaaccccaccctgccagctgggggcaatggggcagggattttggcctctcagaacagctcctagaggctgctcatgactgaatgttttcccaaatcacctaaatatcggtttgctttttgttttgggggagaggatttagcctcttacttccctgatggattcaaagttttatctatctccttatctcctgccctgtcttggcacaactctggatagattgcaggtgtggaatttgctggagtttggtgacttcgtcaaattcctttggattctgttccgccaaatcagcagtctcgtcctgtggatgcagtgactggaatttcccatctgcaaagcatctctgtagcccagattttgtggagccttaagacactccctcaatgccaccctgaccccacggctggagaaccctgtgcttatgtggtgggcagggccactgttgatggaggatggcggggacggggtggtgctcaaaggatctgtggtgctggaggtctacacgcctctcaggacagcgtgtcaggaacctcagagcagcttcacatctgccaaagctgagagggagcgaacttgggaagcattttgctcattgtcctacccaagtattaatagcataatagttgatgccaaaggagatggtgacgtcccttccactgtagttgctgtcacaaccttgacgtctttaagctaatggccgtttgcatctgtgtcttcaaacagatcctggttacagccattttgtgtgattcacttcgggggttaagtaatgcaggattctgcaaacaaggtgtcgccgtccaaatgtactgtcctggcatagagagcactgctttgttttccactgttgtagagaaaactagggagaactttatttttcaataaacttttcttgtgtgaaaaaaaaaaaaaaaaaaa

SEQ ID NO: 40 - protein, 740 aa, Homo sapiens
  GenBank Accession No. NP_002401
MALFTPWKLSSQKLGFFLVTFGFIWGMMLLHFTIQQRTQPESSSMLREQILDLSKRYIKALAEENRNVVDGPYAGVMTAYDLKKTLAVLLDNILQRIGKLESKVDNLVVNGTGTNSTNSTTAVPSLVALEKINVADIINGAQEKCVLPPMDGYPHCEGKIKWMKDMWRSDPCYADYGVDGSTCSFFIYLSEVENWCPHLPWRAKNPYEEADHNSLAEIRTDFNILYSMMKKHEEFRWMRLRIRRMADAWIQAIKSLAEKQNLEKRKRKKVLVHLGLLTKESGFKIAETAFSGGPLGELVQWSDLITSLYLLGHDIRISASLAELKEIMKKVVGNRSGCPTVGDRIVELIYIDIVGLAQFKKTLGPSWVHYQCMLRVLDSFGTEPEFNHANYAQSKGHKTPWGKWNLNPQQFYTMFPHTPDNSFLGFVVEQHLNSSDIHHINEIKRQNQSLVYGKVDSFWKNKKIYLDIIHTYMEVHATVYGSSTKNIPSYVKNHGILSGRDLQFLLRETKLFVGLGFPYEGPAPLEAIANGCAFLNPKFNPPKSSKNTDFFIGKPTLRELTSQHPYAEVFIGRPHVWTVDLNNQEEVEDAVKAILNQKIEPYMPYEFTCEGMLQRINAFIEKQDFCHGQVMWPPLSALQVKLAEPGQSCKQVCQESQLICEPSFFQHLNKDKDMLKYKVTCQSSELAKDILVPSFDPKNKHCVFQGDLLLFSCAGAHPRHQRVCPCRDFIKGQVALCKDC

SEQ ID NO: 41 - DNA, 6971 bp, Homo sapiens
  GenBank Accession No. NM_003033
cccgcctcctcgcttcctcggctccagcctccgccggcggagcccactatgccagacagtttcgacactttgcaaagacaaagagccctagaccggagggaggaggaggaggaagaagagcggagagagaaggaagaggcgatgtgagctgggaagggggcaagtgtccgggacacccacacccctgtattctcctccgaaccccttcatgcccaaatcccggaaactccagcgtgtctccagccgtgttggtaccattttcagatttcatcttcctaaactggaaatgtcaatgagaggaaattaacacccccaagagctgcagtgagcaaatgcattgagcttgggtcaggacaattccatttggggaccagagatggacggtcactcagcctatggagatgaagaaactgaggttcagagaggttaagagactccactgaggtcacacagccgatgacagacaaccttctgtgccttcatcaagctggttgtgtacccaccatgtccctggcgacaggatgggaaagaaaaagccctaattaaggatcgtcagaaaccacagttggaggaggacggcagagacagtttccctccccgctataccaacacccttccttcgaggtcctcgctcctgagggaccctggactgtcacagagattaatgaccccttatcttctttggatgtgaaaggaaatcactggttaaagcttgatcgagagacattatcagctctttaaggattgcagaagaataggctactttattttctgaaaaggtaaatatatgcaagcaaagccaacatgccacgaatggcgttggtctaccacacagccgtgtctgggacacagttgggggtcatcccccagcaggagtgaagtcgagcttagcggcccttgtgtcctcccttggaattcctgccatcccttttgattgagcctccacctctgggatttttcttccatttttctcctctcttaggagggagttcctgctacccatcgtgggaggccaccatcaggactgcgaagatggtgaccctgcggaagaggaccctgaaagtgctcaccttcctcgtgctcttcatcttcctcacctccttcttcctgaactactcccacaccatggtggccaccacctggttccccaagcagatggtcctggagctctccgagaacctgaagagactgatcaagcacaggccttgcacctgcacccactgcatcgggcagcgcaagctctcggcctggttcgatgagaggttcaaccagaccatgcagccgctgctgaccgcccagaacgcgctcttggaggacgacacctaccgatggtggctgaggctccagcgggagaagaagcccaataacttgaatgacaccatcaaggagctgttcagagtggtgcctgggaatgtggaccctatgctggagaagaggtcggtgggctgccggcgctgcgccgttgtgggcaactcgggcaacctgagggagtcttcttatgggcctgagatagacagtcacgactttgtcctcaggatgaacaaggcgcccacggcagggtttgaagctgatgttgggaccaagaccacccaccatctggtgtaccctgagagcttccgggagctgggagataatgtcagcatgatcctggtgcccttcaagaccatcgacttggagtgggtggtgagcgccatcaccacgggcaccatttcccacacctacatcccggttcctgcaaagatcagagtgaaacaggataagatcctgatctaccacccagccttcatcaagtatgtctttgacaactggctgcaagggcacgggcgatacccatctaccggcatcctctcggtcatcttctcaatgcatgtctgcgatgaggtggacttgtacggcttcggggcagacagcaaagggaactggcaccactactgggagaacaacccatccgcgggggcttttcgcaagacgggggtgcacgatgcagactttgagtctaacgtgacggccaccttggcctccatcaataaaatccggatcttcaaggggagatgacgcagtgaagggctgaggatggacgcactgtcacacctctgcatttccagccccagcatcttgctggagccgttccatcccggagcttggaggggcagcctcaggtgtgtgcctgggcaccgctcacagcctcttgcacccagccgttggcagcatctactcagcaaggtcactaagctctgccagcgtggcagagcatgtcttggaacctgtcttgagtggggacaacgtccccccactgctgccctagagctggggagacgctgggaaaggttcaacctccacacactaaaatcattttggctcctggggcaagcttggggaatgaatgtggaagatgcctatattctgagagacaggacagtttcccaggaagatgggcagagacttgagtggcgattacctccagcacagagacgtgccaggcggtgttggcgctcggggcgagatgctgcccttctttgcacgaagcctggcctcttgcttggcgtgataaccctgtcatcttcccaaagctcatttatgagccaccagaggctcctaccccaaagattttcacagaaacttgaggccaggtgccgtggctcacacctgtaatctgaacactttgggaggccgaggcgggaggatcacttgagcccaggagttcaagaccagcctgggcaacatagtgagactcctgtctctacaaaaataaaagatttaaaaaaattagccaggcacggtggcacacacttgtagccccagctactagggaggctgaggagggaggatctcttgtgcctaggagttcgaggctgcagtgggctgtgatcacaccactgcactccagcctgggcaacagagtgagaccctgtctctgaaaaaaaaaaaaaaagaaaagaaaaaaaaccccaaacttggcaccgtgtttctgactcctgcagatgcctcttcccaagcagttgttcctttgagtagtcagtctcatggttctaatcgtggcgagagcggatctgaccacttccatgtgcctttgtatttgggaaagaaaagcatgcattggctgaaatgaaacaaaagcccttacttgggaaaagggacccccaccagcggccctgcttgctccgtagctgggaacatcttttctggtttcctgagccagcacctgaattgcaacgaagctctgaggatactcaacaccacccagcagtgcgtcagaatggaacgtacattctcattctcagactgttcaatatggtgcccgtaacctccaaagccacacaggaggctgccagcagcattttccccaagggcctgagctcagggtcaagtccctgctggccatcttggggctgtcactgggggtctgggtcaaggacatcccaggaatggtaactgccacatacctcatcttcttactccccagctactctcttttcctcattagccttcctgattatttattgatttcttttttttattcaactgacattgtttgcaccctggctctgttggtggtcctggtgttttaatgaagcttgcctcacccagtagctgggaaattaggtgggggtgcttaagggaggtttgtaggagtcctcggacgtgggatattgggggtatctagggcttggatggtttgtggaatgtcctcagcatcctcccgtcccaacccaaccttccttcttcctcattgtggacttggatttattctcaggctaggagtctccaaaactccgtgaaaccttattgctgctgggtgtggagtggagagtgacaggaatgtgggggacggtgattgttggctccagttactaatgtttaagcagaaaaaccactttcttgttgaaaatatccctgaaaaggtcgctgctgctttgaggaggcgtgactttttcctggtggagtgtgacggaggcatggggcctgtgctcccaggctcgggggagccccctctgcacacggggagggaggaacttggggacatcagtcatgggtcacaggtggcttcaggccattcacaagagtccccggaagttgcgtgccaagtttggttttttccctgaatctctgcatatgagcatttttctggagaaaggaccatagcttttattagattctcaaaggttcagaatggggaatgtgttaaacaaaccgaaaacctgtttcagctttaaaatcctccaaaactttaaagacttttcttttttctgagaaaggctggtaaatcactgagtcatcattcagaacatacagcctcgaagggcagagctcacacccatatatgacgttaagagctcaacaaatgtttgttgagtgactgagtgaccccaggggcagactccagatcatcagacactgatacagagagcgatgctatctcctcaactctccctcttctcctaaaagctgagtctatatagggatgacaggctcaggctgagcagtcgacttctctgggttttgctgtgtaagaataggtccctcaacatgaagatgtgtctgcgtctgagccagatgctgcctgggtcggttgcctggcctccgtctggtctccctccctcctactagggtggtcaagctgtgagatctcttccagcctccaaatccagctttcccattttactgatgagaaaatcaaggccacattgcagctgggtggggagtggagcgtgacaggcacgggagaggacagcgattgttgactctagttcctgatgtttaatcagaaaaaccacttttcctgtagagcacatttcctaaaaggctgctgctgtgtagggaggtgtggccttttcctggtgcagtgtgaaggagggaagtgacgggcagtcgtgaactgtctgggacagatagcacaagtcagagtttgagcaaaactagggtgttaccggcgctatgttgaaattgtctggaggcgggctttcccagcgagtctccattcagcatctggaaaaagtgtaaccagaatggaggtgtctgactctcctgtgctctctcagcgccgagctctagctgcaggctgcctgggtggccttctcacaccctcccgtgcaggagactgcatttctctttcccacagcccagcagatagctcattggcttagcaatgggcacttaacagaatccagttgttgcagccagaattaaatgcaccagtctggcttaaaccaactggaactcatccctggggtgaaggtggctgggaattagacaagagtgtgtgttagccaaaaggcacatgcatgctgtcagcaggagaatgaggagcactggttctgggcaggcagtggcaggggctccctcaggcccctgattcccagcccacagctctttctactctgcagacagagttccttggagactggccctgcattcaggcagggagcagaggggtccctgcctgcagcacccagagctgaacctgaagctacaaagatgggctgatgaggtggcccatgaggtgtcagcaacatcccaaccccctgggtctccccagtgagtcagggcactgatttgctatagctggagctacatgcacctctcctcccctcagccaccttttaggggagaaaggagggcagatttgtaacctctggttctctgcagggatcctgggctggaagaaagttcataaatggatgaatgccttttaaaactccagcttttccaagcatcattcaccaaagcatttggttaggcttagagagaaaagctggatatgagaaaatagaatgtaaaataggagggaaaaaaaaaaagaaggtggagagggcagttaagatctgggtgattctttagggaaacggctggttgagaggctttgatggaatcccattctctgctgtggccagaaggtggtgctagaggccagtcccacttggatgtgaccctggcctctgccaggattcaaaccacaaagaacatttggaactgggatgtttgctttgaagcagcccgaaaacaagtgaaaggaaaccaagataactctctctccctccgctggcaaggatcaaaaataccttgtgcagggaagcccgagcctcgaggggccactgcccagctaaagatgactggacaccagccatgcaccatcaggaaccagcacctgtcctcacccctgagaagagccccgggggtatcattatatccatcgcagacatctggtttgcagcaaatgtggctacacgccatcaggattatcctgccctgtggactgggctagctagttttgagatagagtcaacctccccatttttgtttgtcatgaaaacaccagctcctgcacccctggggtgctacctgacacctgtgcaaagaaaaggaggaaaacttagaagaaaaggcagagacaggcaagacagcatctcacagcttgtcaggatcagggcattaccgactattttttcttaccaaaagagcactgaatttcctaggggaaggtgagccacctttacacctcctgtcctccctcccagcccgtcaagcgatcccatcacccagcctcatcactcagcttcttcctagtacaaaactgccatcggttgtacgtcctgagctgtgggacgtcagctttaaccctagcctgtctcagggcctcgccctccagccccccgccccttagggtgatcgtgggtttcttcccttcctcctgcacaatcgcttcccttcactgaattcccttcaaagccaaagtttcttgagcactttttcttgtgtgcagtcttgtgtgtttgggtgttggtgtttttaaatttgctttctattcccccctgcctctctccatgtcgttacgcagctgagcactggttgggatgcattcgaatgacttcagcaagatcctgctttcctcagcccccgctctgttttatttattgtttaatatttccaatgatccaaatcaaagtgaataaacaaagagctattttattgtt

SEQ ID NO: 42 - protein, 340 aa, Homo sapiens
  GenBank Accession No. NP_003024
MVTLRKRTLKVLTFLVLFIFLTSFFLNYSHTMVATTWFPKQMVLELSENLKRLIKHRPCTCTHCIGQRKLSAWFDERFNQTMQPLLTAQNALLEDDTYRWWLRLQREKKPNNLNDTIKELFRVVPGNVDPMLEKRSVGCRRCAVVGNSGNLRESSYGPEIDSHDFVLRMNKAPTAGFEADVGTKTTHHLVYPESFRELGDNVSMILVPFKTIDLEWVVSAITTGTISHTYIPVPAKIRVKQDKILIYHPAFIKYVFDNWLQGHGRYPSTGILSVIFSMHVCDEVDLYGFGADSKGNWHHYWENNPSAGAFRKTGVHDADFESNVTATLASINKIRIFKGR

SEQ ID NO: 43 - DNA, 1189 bp, Homo sapiens
  GenBank Accession No. NM_005793
gacaaggtgaacccgcagccggacttctgctgcactggggctccgaatgacccagaatctggggagtgagatggcctcaatcttgcgaagccctcaggctctccagctcactctagccctgatcaagcctgacgcagtcgcccatccactgattctggaggctgttcatcagcagattctaagcaacaagttcctgattgtacgaatgagagaactactgtggagaaaggaagattgccagaggttttaccgagagcatgaagggcgttttttctatcagaggctggtggagttcatggccagcgggccaatccgagcctacatccttgcccacaaggatgccatccagctctggaggacgctcatgggacccaccagagtgttccgagcacgccatgtggccccagattctatccgtgggagtttcggcctcactgacacccgcaacaccacccatggttcggactctgtggtttcagccagcagagagattgcagccttcttccctgacttcagtgaacagcgctggtatgaggaggaagagccccagttgcgctgtggccctgtgtgctatagcccagagggaggtgtccactatgtagctggaacaggaggcctaggaccagcctgatgcaggtctatgaagaccagtggtagtgcccagacttctcctagacatctagtctaaaacattctcctaggaccagggaagcctggcttacagtgccatttctgctgggcaccaccacctgcctgagggcctagctcaccacagcacatcctccaggatctagccttctatctacctcttctctggaatgtttatggtggttcagaagaatgatgactcctctttgctgagaactgttcatccttcttcaagaagaagcttgccaggccgggcacggtggctcacgcctataatcccagcactttgggaggccgaggcaggcggatcacaaggtcaggaattcgagaccagcctgaccaacatggtgaaaccccatctctactaaaaatacaacaattagccaggcatggtggtgcatgcctgtaatcccagctactcagaggctgaggcaggagaattgcttgaacctgggaggcagagggtgcagtgagccgagatcgtgccattgcactccagcctgggcgacattctgtctcaaaaaaaaaaaaaaaaaaaaaa

SEQ ID NO: 44 - protein, 194 aa, Homo sapiens
  GenBank Accession No. NP_005784
MTQNLGSEMASILRSPQALQLTLALIKPDAVAHPLILEAVHQQILSNKFLIVRMRELLWRKEDCQRFYREHEGRFFYQRLVEFMASGPIRAYILAHKDAIQLWRTLMGPTRVFRARHVAPDSIRGSFGLTDTRNTTHGSDSVVSASREIAAFFPDFSEQRWYEEEEPQLRCGPVCYSPEGGVHYVAGTGGLGPA

SEQ ID NO: 45 - DNA, 3217 bp, Homo sapiens
  GenBank Accession No. NM_001905
tccctcgcccggaggcagagatgcgctggcgcatcaccgccaggagcccacagtgaaagaccatcggatggaaggcgacgcccagaactccaggagaccgctgtgggaggacgcgaggccaggtgacgaataggccaggcgtgagttcccaaacagcctcctccccttcaagagagtaagcttgggccacaggctgggacggaagcagaggggcagacacgccaccacccgcccggcctcgaacctacggcggcacagttcagcggaggcggcccagcggtcctgtcccgcgcctgcgcactccaggccccgccccgccccgcgccctccaggcccggcccgccctccaacctctgcgtgcgcacagcctagagcccgcctccgtgaaagactgccgggcgcatgcggtcggggttgttcactggctgtccggggctccgcgcgcgtcgccggcccagctctgtcgctgacgggaggatctgaagccggccgcaggtcaaagagtaaaatgaagtacattctggttactggtggtgttatatcaggaattggaaaaggaatcattgccagcagtgtgggcacaatactcaagtcatgtggtttacatgtaacttcaatcaaaattgacccctacattaacattgatgcaggaacattctctccttatgagcatggtgaggtttttgtgctggatgatggtggggaagtagaccttgacctgggtaactatgagcggttccttgacatccgcctcaccaaggacaataatctgaccactggaaagatataccagtatgtcattaacaaggaacggaaaggagattacttggggaaaactgtccaagttgtccctcatatcacagatgcaatccaggagtgggtgatgagacaggcgttaatacctgtagatgaagatggcctggaacctcaagtgtgtgttattgagcttggtggaaccgtgggggacatagaaagcatgccctttattgaggccttccgtcagttccaattcaaggtcaaaagagagaacttttgtaacatccacgtcagtctagttccccagccaagttcaacaggggaacagaagactaaacctacccagaatagtgttcgggaacttagaggacttgggctttccccagatctggttgtatgcaggtgctcaaatccacttgacacatcagtgaaggagaaaatatcaatgttctgccatgttgagcctgaacaagtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacagatatgatcgcttgctggagacctgctctattgcccttgtgggcaaatacacgaagttctcagactcctatgcctctgtcattaaggctctggagcattctgcactggccatcaaccacaaattggaaatcaagtacatagattctgcggacttggagcccatcacctcgcaagaagagcccgtgcgctaccacgaagcttggcagaagctctgtagtgctcatggagtgctggttccaggaggatttggtgttcgaggaacagaaggaaaaatccaagcaattgcctgggctcggaatcagaaaaagccttttttgggcgtgtgcttagggatgcagttggcagtggttgaattctcaagaaacgtgctgggatggcaagatgccaattctacagagtttgaccctacgaccagtcatcccgtggtcgtagacatgccagaacacaacccagggcagatgggcggaaccatgaggctgggcaagaggagaaccctgttccagaccaagaactcagtcatgaggaaactctatggagacgcagactacttggaagagaggcaccgccaccgatttgaggtgaatccagtctggaaaaagtgtttggaagaacaaggcttgaagtttgttggccaagatgttgaaggagagagaatggaaattgtggagttagaagatcatcccttttttgttggggttcagtaccaccctgagttcctgtccaggcctatcaagccctccccaccatactttggcctcctcctggcctctgtggggcggctctcacattacctccagaaaggctgcaggctctcacccagggacacctatagtgacaggagtggaagcagctcccctgactctgaaatcaccgaactgaagtttccatcaataaatcatgactgatcttgtagcggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaatatgaagttactttcttaatgtgacctagcaataggcatagctacgtggcactatattctggccagactcgatgtgtactctaacttaagaaataaatcagtaaggcagaacaagaaaaaaaaaaaaaaaaaaa

SEQ ID NO: 46 - protein, 591 aa, Homo sapiens
  GenBank Accession No. NP_001896
MKYILVTGGVISGIGKGIIASSVGTILKSCGLHVTSIKIDPYINIDAGTFSPYEHGEVFVLDDGGEVDLDLGNYERFLDIRLTKDNNLTTGKIYQYVINKERKGDYLGKTVQVVPHITDAIQEWVMRQALIPVDEDGLEPQVCVIELGGTVGDIESMPFIEAFRQFQFKVKRENFCNIHVSLVPQPSSTGEQKTKPTQNSVRELRGLGLSPDLVVCRCSNPLDTSVKEKISMFCHVEPEQVICVHDVSSIYRVPLLLEEQGVVDYFLRRLDLPIERQPRKMLMKWKEMADRYDRLLETCSIALVGKYTKFSDSYASVIKALEHSALAINHKLEIKYIDSADLEPITSQEEPVRYHEAWQKLCSAHGVLVPGGFGVRGTEGKIQAIAWARNQKKPFLGVCLGMQLAVVEFSRNVLGWQDANSTEFDPTTSHPVVVDMPEHNPGQMGGTMRLGKRRTLFQTKNSVMRKLYGDADYLEERHRHRFEVNPVWKKCLEEQGLKFVGQDVEGERMEIVELEDHPFFVGVQYHPEFLSRPIKPSPPYFGLLLASVGRLSHYLQKGCRLSPRDTYSDRSGSSSPDSEITELKFPSINHD

SEQ ID NO: 47 - DNA, 2111 bp, Homo sapiens
  GenBank Accession No. NM_198585
ccaggtgcacagcgcatcgcccgaggctgtcaccgccctgccccgcccaccccagctgtcctggacccaggggcagggagaggctggacgccaggtgcgcggacacagaagcgtctaagcacagcttcctccttgccgctccgggaagtgggcagccagcccaggaaccagtaccacctgcaccatggggctgtcccggaaggagcaggtcttcttggccctgctgggggcctcgggggtctcaggcctcacggcactcattctcctcctggtggaggccaccagcgtgctcctgcccacagacatcaagtttgggatcgtgtttgatgcgggctcctcccacacgtccctcttcctgtatcagtggctggcgaacaaggagaatggcacgggtgtggtcagccaggccctggcctgccaggtggaagggcctggaatctcctcctacacttctaatgctgcacaggctggtgagagcctgcagggctgcttggaggaggcgctggtgctgatcccagaggcccagcatcggaaaacacccacgttcctgggggccacggctggcatgaggttgctcagccggaagaacagctctcaggccagggacatctttgcagcagtcacccaggtcctgggccggtctcccgtggacttttggggtgccgagctcctggccgggcaggccgaaggtgcctttggttggatcactgtcaactacggcttggggacgctggtcaagtactccttcactggagaatggatccagcctccggaggagatgctggtgggtgccctggacatgggaggggcctccacccagatcacgttcgtgcctgggggccccatcttggacaagagcacccaggccgattttcgcctctacggctccgactacagcgtctacactcacagctacctgtgctttggacgggaccagatgctgagcaggctcctcgtggggctggtacagagccgcccggctgccctgctccgtcacccgtgctacctcagcggctaccagaccacactggccctgggcccgctgtatgagtcaccctgtgtccacgccacgcccccgctgagcctcccccagaacctcacagttgaagggacaggcaaccctggagcctgcgtctcagccatccgggaacttttcaacttctccagctgccagggccaggaggactgcgcctttgacggggtctaccagcccccgctgcggggccagttctatgtggaggccagctaccctgggcaggaccgctggctgcgggactactgtgcctcaggcctgtacatcctcaccctcctgcacgagggctacgggttcagcgaggagacctggcccagcctcgagttccgaaagcaggcgggcggtgtggacattggctggacactgggctacatgctgaacctgaccgggatgatcccggccgatgcgccggctcagtggcgggcagagagctacggcgtctgggtggccaaagtggtgttcatggtgctggccctggtggcggtggtgggggctgccttggtccagctcttctggttgcaggactagtgggaaggcggaggtgggcccccacagagcccacaggcagctgcgtcccggatgctggaggcttcctgagccctgagcgccgtggggccttgctctgtggctctgcccacggtcaggtgacagccacctccagggcaccgtcagggtggtgctggccacagaggctgcatgacctcccctcccggcgtccctcccccaacctccttccgcaactgggcttccagggccgtaggtgcctttctgcacacaggccgccaggactcgtggtgtctccaggctgtgtgactgcagggccacatgctgcctgcaaacagggcaagaccacggaggcacaggggtcctgctcctgatggggcctcaggaggggcggagaggggtggaagggagggagctgccccacctggacccccgctctccctgctgttgtctgagcagatggatggagtccaggcctgggggcttctgctgggccagcccggcctcccacacccacttggagggtgagactgcagtgggggttgtttttattaaaagcatcatggacacagca

SEQ ID NO: 48 - protein, 458 aa, Homo sapiens
  GenBank Accession No. NP_940987
MGLSRKEQVFLALLGASGVSGLTALILLLVEATSVLLPTDIKFGIVFDAGSSHTSLFLYQWLANKENGTGVVSQALACQVEGPGISSYTSNAAQAGESLQGCLEEALVLIPEAQHRKTPTFLGATAGMRLLSRKNSSQARDIFAAVTQVLGRSPVDFWGAELLAGQAEGAFGWITVNYGLGTLVKYSFTGEWIQPPEEMLVGALDMGGASTQITFVPGGPILDKSTQADFRLYGSDYSVYTHSYLCFGRDQMLSRLLVGLVQSRPAALLRHPCYLSGYQTTLALGPLYESPCVHATPPLSLPQNLTVEGTGNPGACVSAIRELFNFSSCQGQEDCAFDGVYQPPLRGQFYVEASYPGQDRWLRDYCASGLYILTLLHEGYGFSEETWPSLEFRKQAGGVDIGWTLGYMLNLTGMIPADAPAQWRAESYGVWVAKVVFMVLALVAVVGAALVQLFWLQD

SEQ ID NO: 49 - DNA, 2288 bp, Homo sapiens
  GenBank Accession No. NM_017443
cctaaagggatccgccccgccgagtcagccacgccttcgtctcccacgcgctgcgcccggccgcgccgtcacccagcagcggcgcagggcaccatgggaaacggacggaagctccattgagccaaataagttggccacgtggggcggaacggaaacctcgcagggtcagaccgtagcgacgcgggaagtccggacgcagtagctccctgaagcggaggcgaaggggagtttaagccccagcggcggcaatggcggagaggcccgaggacctaaacctgcccaatgccgtgatcaccaggatcatcaaggaggcgctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgttttgcttcatcaatctgaaggttatggccttttgacaagagggattctgaacgactaaattagtcagtttgctcgcttttgtttacttaaatgtatggttagatggtttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaattttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaaccccaggcttcctcttcttgtagtccatctcccagacttgtgactatggcttttcattcttcaattcatgacgagtgccaaacttgattttctctaggcacagctttctccctctgtgcctcctgcttcctttctctctcctgcctctcctctgctccccatcccactttctcatctgcctccttttctcacttctgtcagtctgtaagctttgataacctgcttaatactccaaagtgtgagttcctctgatctcttgattccttagttctaatctcacgttttgtttttaagagatggagtctctcactctgtggcccaggctggagtgcagtggcatgatcatagctcattgcatccttgaaatcctgggctcaggtgatcctcccgcctgagcctcctgagtatctgggactacagatgcgtgccaccaagcctggctaattttgtctcatgtcttctaaaaattattttgtgaagccccttcacaaaaaaccttaagggaaatctgatggtgctcaggaatctaactctccctaaaccatcctctttaactgcttctaaaatatctctgttggcctttcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaaaaaaaaaaaaaaaaaaaaaa

SEQ ID NO: 50 - protein, 147 aa, Homo sapiens
  GenBank Accession No. NP_059139
MAERPEDLNLPNAVITRIIKEALPDGVNISKEARSAISRAASVFVLYATSCANNFAMKGKRKTLNASDVLSAMEEMEFQRFVTPLKEALEAYRREQKGKKEASEQKKKDKDKKTDSEEQDKSRDEDNDEDEERLEEEEQNEEEEVDN

SEQ ID NO: 51 - DNA, 7859 bp, Homo sapiens
  GenBank Accession No. NM_006231
cgccaaatttctcccctgaagcagaggtggtagccaacggctccatgtctctgaggagcggcgggcggcggcgcgcggacccaggcgcggatggcgaggccagcagggatgatggcgccacttcctcagtttcggcactcaagcgcctggaacggagtcagtggacggataagatggatttgcggtttggttttgagcggctgaaggagcctggtgagaagacaggctggctcattaacatgcatcctaccgagattttagatgaagataagcgcttaggcagtgcagtggattactactttattcaagatgacggaagcagatttaaggtggctttgccctataaaccgtatttctacattgcgaccagaaagggttgtgagcgagaagtttcatcttttctctccaagaagtttcagggcaaaattgcaaaagtggagactgtccccaaagaggatctggacttgccaaatcacttggtgggtttgaagcgaaattacatcaggctgtccttccacactgtggaggatcttgtcaaagtgaggaaggagatctcccctgccgtgaagaagaacagggagcaggatcacgccagcgacgcgtacacagctctgctttccagtgttctgcagaggggcggtgtcattactgatgaagaggaaacctctaagaagatagctgaccagttggacaacattgtggacatgcgcgagtacgatgttccctaccacatccgcctctccattgacctgaagatccacgtggctcattggtacaatgtcagataccgaggaaatgcttttccggtagaaatcacccgccgagatgaccttgttgaacgacctgaccctgtggttttggcatttgacattgagacgaccaaactgcccctcaagtttcctgatgctgagacagaccagattatgatgatttcctacatgatcgatggccagggctacctcatcaccaacagggagattgtttcagaagatattgaagattttgagttcacccccaagccagaatatgaaggccccttttgtgtcttcaatgaacccgatgaggctcatctgatccaaaggtggtttgaacacgtccaggagaccaaacccaccatcatggtcacctacaacggggacttttttgactggccatttgtggaggcccgggcagcagtccacggtctgagcatgcagcaggagataggcttccagaaggacagccagggggagtacaaggcgccccagtgcatccacatggactgcctcaggtgggtgaagagggacagttaccttcctgtgggcagtcataatctcaaggcggccgccaaggccaagctaggctatgatcccgtggagctagacccggaggacatgtgccggatggccacggagcagccccagactctggccacgtattctgtgtcagatgctgtcgccacttactacctgtacatgaagtacgtccacccattcatctttgctctgtgcaccattattcccatggagcccgacgaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatgaatcctgccgcctttgacttcctgctgcagcgggttgagaagaccttgcgccacgcccttgaggaagaggagaaagtgcctgtggagcaagtcaccaactttgaagaggtgtgtgatgagattaagagcaagcttgcctccctgaaggacgttcccagccgcatcgagtgtccactcatctaccacctggacgtgggggccatgtaccccaacatcatcctgaccaaccgcctgcagccctctgccatggtggacgaagccacctgtgctgcctgtgacttcaataagcctggagcaaactgccagcggaagatggcctggcagtggaggggcgagttcatgccagccagtcgcagcgaataccatcggatccagcaccagctggagtcagagaagttcccccccttgttcccagaggggccagctcgggcctttcatgaactgtcccgcgaggaacaggcgaaatacgagaagagaaggctggcggattactgccggaaagcctacaagaagatccacatcaccaaggtggaagagcgtctcaccaccatctgccagcgggaaaactccttctacgtggacaccgtgcgtgccttccgggacaggcgttacgagttcaaagggctccacaaggtgtggaaaaagaagctctcggcggccgtggaggtgggcgacgcggctgaggtgaagcgctgcaagaacatggaggtgctgtatgactcgctgcagctggcccacaagtgcatcctgaactccttctatggctatgtcatgcgcaagggggctcgctggtactccatggagatggctggcatcgtctgcttcacaggggccaacatcatcacccaggcacgggagctgatcgagcagattgggaggcccttagagctggacacagatggtatatggtgcgtcctgcccaacagcttcccagaaaattttgtcttcaagacgaccaatgtgaagaagcccaaagtgaccatctcctacccaggcgccatgttgaacatcatggtcaaggaaggcttcaccaatgaccagtaccaggagctggctgagccgtcctcactcacctacgtcacccgctcagagaacagcatcttttttgaggttgatgggccctaccttgccatgattcttccagcctccaaggaagaaggcaagaaattgaagaagaggtatgctgtgttcaatgaagacggttctctggctgagctcaagggctttgaggtcaaacgccgcggggaactgcagctgattaagatcttccaatcctcggtgtttgaggccttcctcaagggcagcacgctggaagaggtgtatggctctgtagccaaggtggctgactactggctggacgtgctgtacagcaaggcagccaacatgcctgactctgagctattcgagctcatctctgagaaccgttccatgtctcggaagctggaagattacggggagcagaagtctacgtccatcagcacagcaaagcgcctggccgagttcctgggagaccagatggtcaaggatgcagggctgagttgccgctacatcatctcccgcaagcccgagggctcccctgtcacggagagggccatcccacttgccattttccaagcagagcccacggtgaggaagcactttctccggaaatggctcaagagctcttcccttcaagactttgatattcgagcaattctggattgggactactacattgagcggctgggaagcgccatccagaagatcatcaccatccctgcggccctgcagcaggtaaagaacccagtgccacgtgtcaaacaccccgactggctgcacaaaaaactgctggagaagaatgatgtctacaagcagaagaagatcagtgagctcttcaccctggagggcaggagacaggtcacgatggccgaggcctcagaagacagtccgaggccaagtgctcctgacatggaggacttcggcctcgtaaagctgcctcacccagcagcccctgtcactgtgaagaggaagcgagttctttgggagagccaggaggagtcccaggacctcacgccgactgtgccctggcaggaaatcttggggcagcctcccgccctgggaaccagccaggaggaatggcttgtctggctccggttccacaagaagaagtggcagctgcaggcccggcagcgcctcgcccgcaggaagaggcagcgtctggagtcggcagagggtgtgctcaggcccggggccatccgggatggtcctgccacggggctggggagcttcttgcgaagaactgcccgcagcatcctggaccttccgtggcagattgtgcagatcagcgagaccagccaggccggcctgttcaggctgtgggcgctcgttggcagtgacttgcactgcatcaggctgagcatcccccgtgtgttctacgtgaaccagcgagtcgctaaagcggaggagggtgcttcgtatcgcaaggtaaatcgggtccttcctcgctccaacatggtctacaatctctatgagtattcagtgccagaggacatgtaccaggaacacatcaacgagatcaacgctgagctgtcagcgccagacatcgagggcgtatatgagactcaggttccgttactgttccgggccctggtgcacctgggctgtgtgtgtgtggtcaataaacagctggtgaggcacctttcaggctgggaagcagagacctttgctcttgagcacctggagatgcgctctctggcccagttcagctacctggaaccagggagtatccgccatatctacctgtaccaccacgcacaggcccacaaagcgctcttcgggatcttcatcccctcacagcgcagggcatccgtctttgtgctggacactgtgcgcagcaaccagatgcccagccttggcgccctgtactcagcagagcacggcctcctcctggagaaggtgggccctgagctcctgccaccccccaaacacaccttcgaagttcgggcagaaactgacctgaagaccatctgcagagccatccagcgattcctgctcgcctacaaggaggagcgccgggggcccacactcatcgctgttcagtccagctgggagctgaagaggctggccagtgaaattcctgtcttggaggaattcccactggtgcctatctgtgtggctgacaagatcaactatggggtcctggactggcagcgccatggagcccggcgcatgatccgtcactacctcaacctggacacctgcctgtcgcaggccttcgagatgagcaggtactttcacattcccattgggaacctaccagaggacatctccacattcggctccgacctcttctttgcccgccacctccagcgccacaaccacctgctctggctgtcccctacagcccgccctgacctgggtggaaaggaggctgatgacaactgtcttgtcatggagttcgatgaccaagccactgttgagatcaacagttcaggctgttactccacagtgtgtgtggagctggaccttcagaacctggccgtcaacaccattctccagtctcaccatgtcaacgacatggagggggccgacagcatggggatcagcttcgacgtgatccagcaggcctccctggaggacatgatcacgggtggtcaggctgccagtgccccggccagctacgatgagacagccctgtgctctaacaccttcaggatcctgaagagcatggtcgtgggctgggtgaaggagatcacccagtaccacaacatctatgcagacaaccaggtgatgcacttctaccgctggcttcggtcgccatcctctctgcttcatgaccctgccctgcaccgcacactccacaacatgatgaagaagctcttcctgcagctcatcgctgagttcaagcgcctggggtcatcagtcatctacgccaacttcaaccgcatcatcctctgtacaaagaagcgccgtgtggaagatgccatcgcttacgtggagtacatcaccagcagcatccattcaaaggagaccttccattctctgacaatttctttctctcgatgctgggaatttcttctctggatggatccatctaactatggcggaatcaaaggaaaagtttcatctcgtattcactgtggactgcaagactcccagaaagcagggggagcagaggatgagcaggaaaatgaggacgatgaggaggaaagagatggggaggaggaggaagaggcggaggaatccaacgtggaggatttactggaaaacaactggaacattttgcagtttttgccacaggcagcctcctgccagaactacttcctcatgattgtttcagcgtacatcgtggccgtgtaccactgcatgaaggacgggctgaggcgcagtgctccagggagcacccccgtgaggaggaggggggccagccagctctcccaggaggccgagggggcggtcggagcccttcccggaatgatcaccttctctcaggattatgtcgcaaatgagctcactcagagcttcttcaccatcactcagaagattcagaagaaagtcacaggctctcggaactccactgagctctcagagatgtttcctgtcctccccggttcccacttgctgctcaataaccctgccctggagttcatcaaatacgtgtgcaaggtgctgtccctggacaccaacatcacaaaccaggtgaataagctgaaccgagacctgcttcgcctggtggatgtcggcgagttctccgaggaggcccagttccgagacccctgccgctcctacgtgcttcctgaggtcatctgccgcagctgtaacttctgccgcgacctggacctgtgtaaagactcttccttctcagaggatggggcggtcctgcctcagtggctctgctccaactgtcaggcgccctacgactcctctgccatcgagatgacgctggtggaagttctacagaagaagctgatggccttcaccctgcaggacctggtctgcctgaagtgccgcggggtgaaggagaccagcatgcctgtgtactgcagctgcgcgggagacttcgccctcaccatccacacccaggtcttcatggaacagatcggaatattccggaacattgcccagcactacggcatgtcgtacctcctggagaccctggagtggctgctgcagaagaacccacagctgggccattagccagccccgggccccgggtgcctctgcgtccgtgccaggcctcctgatgccaaggccacatccccgtgcttccagtgaccagaccactgaccaccctgactgtccaaacctgtgaccccaggccagggaacggggaggaaaccaaagaaaaccattttcagggagctcagacgtcacaggagggagcgggagcaggatgtggccctggcctcgccagagcacctgaagaagcaggccgtgagcgaggctgcgagtgccctgggcgccgtttctcacgcagtgaatgcttttccaggcctctgttgcttcctgcaccacacctggtggggtgggagcgtcctctaggtgcccctagttctttgtcctgcctcccagagggaggaaaagcccctgggggcttctggctccctgagattgggctctgagacgagacgggttcccaaggccctggtggggctggagtctcacctgtttgcatggagaaatgggctggccccacagcctcacaggagcagtttgtgggctggtttccccaggaatccagaccctaacccgtgagaatctggattttggcttgtgagccctgcttatttggagccgggtctagagggaaccctctatcagcctcaggaaaacaagacctctgtgcacctcacttttggctcactgcagcccttgtccttcacctccacacaggaccagctggaagcagaaagaagaaaggccaatttcacagggcaccaaacaagtatgaaatgtaaatcagaaatgcagacaccccagacgagagcctcacaggagggagggggccccacaggctccccaggaggctcgtgtctttggcccagagccagccttagtttgtccctgccatctactgtctgaggccatcgctgctacactttgtttttatttgtatttcatactgaagtttcaaaaaaaaaaaaaaaaaaa

SEQ ID NO: 52 - protein, 2286 aa, Homo sapiens
  GenBank Accession No. NP_006222
MSLRSGGRRRADPGADGEASRDDGATSSVSALKRLERSQWTDKMDLRFGFERLKEPGEKTGWLINMHPTEILDEDKRLGSAVDYYFIQDDGSRFKVALPYKPYFYIATRKGCEREVSSFLSKKFQGKIAKVETVPKEDLDLPNHLVGLKRNYIRLSFHTVEDLVKVRKEISPAVKKNREQDHASDAYTALLSSVLQRGGVITDEEETSKKIADQLDNIVDMREYDVPYHIRLSIDLKIHVAHWYNVRYRGNAFPVEITRRDDLVERPDPVVLAFDIETTKLPLKFPDAETDQIMMISYMIDGQGYLITNREIVSEDIEDFEFTPKPEYEGPFCVFNEPDEAHLIQRWFEHVQETKPTIMVTYNGDFFDWPFVEARAAVHGLSMQQEIGFQKDSQGEYKAPQCIHMDCLRWVKRDSYLPVGSHNLKAAAKAKLGYDPVELDPEDMCRMATEQPQTLATYSVSDAVATYYLYMKYVHPFIFALCTIIPMEPDEVLRKGSGTLCEALLMVQAFHANIIFPNKQEQEFNKLTDDGHVLDSETYVGGHVEALESGVFRSDIPCRFRMNPAAFDFLLQRVEKTLRHALEEEEKVPVEQVTNFEEVCDEIKSKLASLKDVPSRIECPLIYHLDVGAMYPNIILTNRLQPSAMVDEATCAACDFNKPGANCQRKMAWQWRGEFMPASRSEYHRIQHQLESEKFPPLFPEGPARAFHELSREEQAKYEKRRLADYCRKAYKKIHITKVEERLTTICQRENSFYVDTVRAFRDRRYEFKGLHKVWKKKLSAAVEVGDAAEVKRCKNMEVLYDSLQLAHKCILNSFYGYVMRKGARWYSMEMAGIVCFTGANIITQARELIEQIGRPLELDTDGIWCVLPNSFPENFVFKTTNVKKPKVTISYPGAMLNIMVKEGFTNDQYQELAEPSSLTYVTRSENSIFFEVDGPYLAMILPASKEEGKKLKKRYAVFNEDGSLAELKGFEVKRRGELQLIKIFQSSVFEAFLKGSTLEEVYGSVAKVADYWLDVLYSKAANMPDSELFELISENRSMSRKLEDYGEQKSTSISTAKRLAEFLGDQMVKDAGLSCRYIISRKPEGSPVTERAIPLAIFQAEPTVRKHFLRKWLKSSSLQDFDIRAILDWDYYIERLGSAIQKIITIPAALQQVKNPVPRVKHPDWLHKKLLEKNDVYKQKKISELFTLEGRRQVTMAEASEDSPRPSAPDMEDFGLVKLPHPAAPVTVKRKRVLWESQEESQDLTPTVPWQEILGQPPALGTSQEEWLVWLRFHKKKWQLQARQRLARRKRQRLESAEGVLRPGAIRDGPATGLGSFLRRTARSILDLPWQIVQISETSQAGLFRLWALVGSDLHCIRLSIPRVFYVNQRVAKAEEGASYRKVNRVLPRSNMVYNLYEYSVPEDMYQEHINEINAELSAPDIEGVYETQVPLLFRALVHLGCVCVVNKQLVRHLSGWEAETFALEHLEMRSLAQFSYLEPGSIRHIYLYHHAQAHKALFGIFIPSQRRASVFVLDTVRSNQMPSLGALYSAEHGLLLEKVGPELLPPPKHTFEVRAETDLKTICRAIQRFLLAYKEERRGPTLIAVQSSWELKRLASEIPVLEEFPLVPICVADKINYGVLDWQRHGARRMIRHYLNLDTCLSQAFEMSRYFHIPIGNLPEDISTFGSDLFFARHLQRHNHLLWLSPTARPDLGGKEADDNCLVMEFDDQATVEINSSGCYSTVCVELDLQNLAVNTILQSHHVNDMEGADSMGISFDVIQQASLEDMITGGQAASAPASYDETALCSNTFRILKSMVVGWVKEITQYHNIYADNQVMHFYRWLRSPSSLLHDPALHRTLHNMMKKLFLQLIAEFKRLGSSVIYANFNRIILCTKKRRVEDAIAYVEYITSSIHSKETFHSLTISFSRCWEFLLWMDPSNYGGIKGKVSSRIHCGLQDSQKAGGAEDEQENEDDEEERDGEEEEEAEESNVEDLLENNWNILQFLPQAASCQNYFLMIVSAYIVAVYHCMKDGLRRSAPGSTPVRRRGASQLSQEAEGAVGALPGMITFSQDYVANELTQSFFTITQKIQKKVTGSRNSTELSEMFPVLPGSHLLLNNPALEFIKYVCKVLSLDTNITNQVNKLNRDLLRLVDVGEFSEEAQFRDPCRSYVLPEVICRSCNFCRDLDLCKDSSFSEDGAVLPQWLCSNCQAPYDSSAIEMTLVEVLQKKLMAFTLQDLVCLKCRGVKETSMPVYCSCAGDFALTIHTQVFMEQIGIFRNIAQHYGMSYLLETLEWLLQKNPQLGH

SEQ ID NO: 53 - DNA, 1091 bp, Homo sapiens
  GenBank Accession No. NM_001161
ctattgatgggcccaagcgtaaccaggctcttctgattggccggtgtacttcagtttccgtccaaggtccgcctcctacctccttctgcttcggggagggcatgggatcagctacctgtttctgcctcaaccacggaccaataatatgagatctttgttcaccagttctacagtgatggggtgcttccttttggcttctggaatgggtgcgtttgcttctgaggatctccagtgtcacaacaaacacatgccagccctgttttacagggagccctggaggagttgggatagaggccacattgactgagggtagttgccagggtcctgcagttatacacaaagtccttaggataagaccatggccttgagagcatgtggcttgatcatcttccgaagatgcctcattcccaaagtggacaacaatgcaattgagtttttactgctgcaggcatcagatggcattcatcactggactcctcccaaaggccatgtggaaccaggagaggatgacttggaaacagccctgagggagacccaagaggaagcaggcatagaagcaggccagctgaccattattgaggggttcaaaagggaactcaattatgtggccaggaacaagcctaaaacagtcatttactggctggcggaggtgaaggactatgacgtggagatccgcctctcccatgagcaccaagcctaccgctggctggggctggaggaggcctgccagttggctcagttcaaggagatgaaggcagcgctccaagaaggacaccagtttctttgctccatagaggcctgagctgactggagcagagtcatttgcttcagcaggatccttgtgggccttctaagatgaagccaccctcaggtccagggaaggttgtgctggtatttggctcatgacagccaagagcagatttgtgaaatcggctcaactcccaggtgagagcaagcaaaaatcttggctgggtggaaaggaaggcaaaagagtaaaaattaaaaaggccaggcccagtaagtgtaccttgtactttataaataaacctcaagcagctcaaggttgtccttctaaaaaaaaaaaaaaaaaa

SEQ ID NO: 54 - protein, 147 aa, Homo sapiens
  GenBank Accession No. NP_001152
MALRACGLIIFRRCLIPKVDNNAIEFLLLQASDGIHHWTPPKGHVEPGEDDLETALRETQEEAGIEAGQLTIIEGFKRELNYVARNKPKTVIYWLAEVKDYDVEIRLSHEHQAYRWLGLEEACQLAQFKEMKAALQEGHQFLCSIEA

SEQ ID NO: 55 - DNA, 1227 bp, Homo sapiens
  GenBank Accession No. NM_012145
cggcccagggcgcaggcgcgggtgtcggtcccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccggaaagatcaactgaaatcggcaaacttctgagttcctacttgcaaaagaaaagtgacgtggaggatcactcggtgcacctgcttttttctgcaaatcgctgggaacaagtgccgttaattaaggaaaagttgagccagggcgtgaccctcgtcgtggacagatacgcattttctggtgtggccttcaccggtgccaaggagaatttttccctagattggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaagatggtggatgcttccaaaagcatcgaagctgtccatgaggacatccgcgtgctctctgaggacgccatccgcactgccacagagaagccgctgggggagctatggaagtgacccaaggctgcccactggagacgcctctccctgcagtcccccgagaggtgggagactcgcggaaggccccgtccccagcagagtccagaccccacaacttcaggagctctttcccggcagcagagatctgcaggctgcctcttctgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaacgacctgaaaattgttaaaaaaaaaaaaaaaaaa

SEQ ID NO: 56 - protein, 212 aa, Homo sapiens
  GenBank Accession No. NP_036277
MAARRGALIVLEGVDRAGKSTQSRKLVEALCAAGHRAELLRFPERSTEIGKLLSSYLQKKSDVEDHSVHLLFSANRWEQVPLIKEKLSQGVTLVVDRYAFSGVAFTGAKENFSLDWCKQPDVGLPKPDLVLFLQLQLADAAKRGAFGHERYENGAFQERALRCFHQLMKDTTLNWKMVDASKSIEAVHEDIRVLSEDAIRTATEKPLGELWK

SEQ ID NO: 57 - DNA, 2122 bp, Homo sapiens
  GenBank Accession No. NM_007370
gcgagagttgcttttgcgcgcgaactgtaagtgccagggtctcagggtcaggtcgcggctggtcactgtgcaggcgcttgggtgacgcgacgatctcagcggatctggtcaccttcgtctccccgccatggagacctcagcactcaagcagcaggagcagcccgcggcgaccaagatcaggaacctgccctgggttgaaaaataccggccacagaccctgaatgatctcatttctcatcaggacattctgagtaccattcagaagtttatcaatgaagaccgactgccacacttgcttctctacggtcccccagggacaggcaagacatctaccatcctagcctgtgcgaaacagctatataaagacaaagaatttggctccatggtcttggagctgaatgcttcagatgaccgaggaatagacatcattcgaggaccgatcctgagctttgctagcacaaggacaatatttaagaaaggctttaagctagtgatcttggatgaagcagacgccatgactcaggacgcccagaatgccttgagaagagtaattgagaaattcacagaaaataccagattctgcctcatctgtaactatctgtcaaagatcatccctgccttgcagtcccgctgcacgaggtttcggttcggtcccctgactcctgaactcatggttccccgcctggaacatgtcgtggaagaagagaaagttgatataagtgaagatggaatgaaagcactagtcactctttccagtggagacatgcgtagggctctgaacattttgcagagcaccaatatggcctttgggaaggtgacagaggagactgtctacacctgcaccgggcacccgctcaagtcagacattgccaacatcctggactggatgttgaatcaagatttcaccacagcctacagaaatattacagagttgaaaactctgaaggggttggcactgcatgatatcctgacagagatacacttgtttgtgcatagagttgactttccatcttcagttcgaatacatttattgaccaaaatggcagacattgagtacaggctttctgttggcaccaacgagaagatccagctgagctccctcattgctgcatttcaagtcaccagagacctgattgttgcagaggcctagatgctctgagggccattcacaattctcagggctcagcagtgatgggagaacagaggacagttccaggataaactgctgcctggggctgtgggatgaatcagtcaccccgaatcttggaaaaacccccttccaggagaggatgggcaggcatttaaaaagtaccatttttgtggttgtttggagcagggatgtacaaaataattttaatgtattaactcatactgcctgtcttttataggggaaaaaaataaccttttttattttaaagttataaggtttttaccttttagttgcttggatgacagggaattagcctaccccattttggtctggaacagaagactttcaaatttaatatggtccaagtgtcttcctactcaaggtaaacattatctccaaaattacatttatgattctaatatttggcattgtgtctgtatctaatttaaacagatgttaatggacgtctggccgaaactattatacttttataagatgagctgaatcctcttactttaaaaactggtctttttatttaccctctgtggtagaagagtcaccagcaggttccaaattgatgtgtatgataggaaaaaaaccttaattttaaatataatatagagccttaaactatgccactgggtggcagaggctgtataaaacgcacttgttttcatgcaggagcggggcaagtaaggttgagcctgactgtaaacctagaactgcggaaggactgggacttttgtacaaatttcacatttattttacagcaatcatgctgcatttgtgttagtgttctttataataaaaaacaaagcagcctcctggctggctgtgttacaagtgactcttccttagacagctagaaagatgctgactttgtcaaacttgcatttatatgaaaaccttctgtctctaatatcacagaataaactttctttagatgctgttctttataaaaaaaaaaaaaaa

SEQ ID NO: 58 - protein, 340 aa, Homo sapiens
  GenBank Accession No. NP_031396
METSALKQQEQPAATKIRNLPWVEKYRPQTLNDLISHQDILSTIQKFINEDRLPHLLLYGPPGTGKTSTILACAKQLYKDKEFGSMVLELNASDDRGIDIIRGPILSFASTRTIFKKGFKLVILDEADAMTQDAQNALRRVIEKFTENTRFCLICNYLSKIIPALQSRCTRFRFGPLTPELMVPRLEHVVEEEKVDISEDGMKALVTLSSGDMRRALNILQSTNMAFGKVTEETVYTCTGHPLKSDIANILDWMLNQDFTTAYRNITELKTLKGLALHDILTEIHLFVHRVDFPSSVRIHLLTKMADIEYRLSVGTNEKIQLSSLIAAFQVTRDLIVAEA

SEQ ID NO: 59 - DNA, 1822 bp, Homo sapiens
  GenBank Accession No. NM_032940
ggcctcgctgactgacttccggtgttggcggtggcgccgcgcagtcaccgcggagcagacgcggaggctggtggcccctgggcgagatgccgtacgccaaccagcctaccgtgcggatcacggagctcactgacgagaatgtcaagttcatcatcgagaacaccgacctggcggtggccaattcgattcggagggtcttcatcgctgaggttcccataatagccattgactgggttcagattgatgccaattcctcagttcttcatgatgaattcattgctcacaggcttggattaattcccctcattagtgatgacattgtggacaagctgcagtactctcgggactgcacatgtgaggagttctgccccgagtgctcggtggagttcaccctcgatgtgcggtgcaatgaagaccagacgcgacatgtcacgtctcgagacctcatctccaacagcccccgggtcattccggtgacatcccggaaccgagataatgaccccaatgactacgtggagcaggatgacatcctcatcgtcaagttgagaaagggccaggagctgagacttcgagcctatgccaaaaagggctttggcaaggagcatgccaagtggaaccctactgcaggggtggcttttgaatacgatccagacaatgccctgaggcacacagtgtaccccaagcccgaggaatggccaaagagtgagtactcggagctggatgaggatgagtcgcaggctccctatgaccccaacggcaagccagaaaggttttactacaatgtggagtcctgtggctctctgcgtcctgaaaccattgtcctgtcagccctctcaggattgaagaagaaactgagtgatttacaaactcaattaagccacgagatccagagtgatgtgctaaccataaattaactgcagcttgcctgcttcagcaaaaacggagattcaggccagcagctggatatgggggtctctcttcagactcttctcgtttctgagaatctagtctactgttggttgagcttcttggcaggacatcagtaccaactagaagtgggtcatagatagattaccagggatgcagtggtgtttaggcaggataggtctttactggccctgactgctgttaataattggcagcagtgctccccagatcccagaaggtccctgctggagtgtttccagtgcacctgtagggaaccaactagacttctctcctggttagtccagctctttactctaaaccctttctgtccaaaatgagtcattttcagttgtaccttagatgtctggtgttgaggatcaagtgccatagcctttattcagggggcctataaacccttccagttcttgccccagggctggcctgctagcgcttcaaattcccaggtgtccctaatttgagaagtaaccttttggaatagcattagaccctggctgtcccctccccaccaaataaacatgatatttcattctctgtccagcagtcatgaaccccttcacctccaatgacctgatcatttagtttggtgggggtgggggtgggggtgggggtggaagcagccgcaggagcaagggcccctcccacatacacaggaggagtatttcatttctccttaatgaaggctctggccctaacccctcagcactgtctccagataggaacatgcacaaagcagttaattaggcagcctggagaaaaccagagatccagtacagaaaggaaaggatatttattgattaacagaagttgtctttttaaaagtgtttatttttggcaataaagagcacaacataatctcaaaaaaaaaaaaaaaaaa

SEQ ID NO: 60 - protein, 275 aa, Homo sapiens
  GenBank Accession No. NP_116558
MPYANQPTVRITELTDENVKFIIENTDLAVANSIRRVFIAEVPIIAIDWVQIDANSSVLHDEFIAHRLGLIPLISDDIVDKLQYSRDCTCEEFCPECSVEFTLDVRCNEDQTRHVTSRDLISNSPRVIPVTSRNRDNDPNDYVEQDDILIVKLRKGQELRLRAYAKKGFGKEHAKWNPTAGVAFEYDPDNALRHTVYPKPEEWPKSEYSELDEDESQAPYDPNGKPERFYYNVESCGSLRPETIVLSALSGLKKKLSDLQTQLSHEIQSDVLTIN

SEQ ID NO: 61 - DNA, 2338 bp, Homo sapiens
  GenBank Accession No. NM_004805
gctccgcgcttctgcttccggcggcgctggtggtggcgcgcggcgcggcgcggcgatggcggcgggtggcagcgatccgcgggctggcgacgtagaggaggacgcctcacagctcatctttcctaaagagtttgaaacagctgagacacttctaaattcagaagttcatatgcttctggaacatcgaaagcagcagaatgagagtgcagaggacgaacaggagctctcagaagtcttcatgaaaacattaaactacacagcccgtttcagtcgtttcaaaaacagagagaccattgccagtgttcgtagcttgctactccagaaaaagcttcataagtttgagttggcctgtttggccaacctttgcccagagactgctgaggagtccaaggctctaatcccaagcttggagggacggtttgaagatgaggagctgcagcagattcttgatgatatccagacaaagcgcagctttcagtattaatctccaaacatcactgctgctcggagaaaccacatccccaggcataacaccaccttcccactgtctggggctgacttgcacagaaattctgttgaagacagttgagaattcctttggagaaaacagcccagcttggcgtggggttaggttgctgtttcaaataactcacaggcccaggtgacatggaatcttggagcagccttgtgcagtggcagccagtggcttcctgaacgtgcctctgcgaagtgtgagatgaggggtcacataaccacactgttgactacctcattcctggtttttggcctccacatcatcttttttcttaatatttcatgttttaatttcagggtgtttatactttttgaaactagaccagaagatagtagactttatagagaaagaccagttttacctagatactaaaggaagaattaaaccgctgttagtttgaaatgctttttttttttttttttaaatggagatagggtcttaactcttgtccaggctggaggagtgcagtcgtacagtcatggctcactgaagtcttgaccccgctgcctcagcctcccaaataactggggccacaggtgtgcaccacaactctcagctaatttttaaaattttttatagaggtggggttttactatgctgtccagactggtcttaaactcctgggctcaagtgatccccctgccttggcctcccaaactggtgagattacaggcatgagccaccacaactggcctgaaattcttaaaggatgggagtgtcgatgacagcaccttggcatcgttgtgcctaacctgggagacggaagaagcacgccatgggaagtgtttacacttggggacaagtgctaagtattgtggagcccatagccccttgagatagatggctactttgcctttcttcttgaactgtcttgcagaatgtggatttggggtaagtggtcttgaaggattcatttagtcaccctcaaattaagatttttacttcatctttcttgggcctgcacctccaagataacaaagaagaagcaatggtcgtgccaaagaggtccacaaccaggtgtgcactgttcactgcagcccatttgctgtatgaactgtggttgttgtgtgcccaatgacaaggctactaagaaattcatcatttgaaacgtagaggccgcagcagtcagcgatgtttctgaaatgagcatccttgacgcctgtgtacttcccaggctggatgtgaagctacattaccatgtgagttgtgccattcacagcacagtggtgaggaattgagctcatgaagcaggcaaggaccgaacacctccaccccaacgtagacctgcaggtgctgccccatgacctccaccaaagcccatataaggagcggagttgttaaggactgaagaaaaacttctctggagaaaaataaaattgcaattctacttaaaaaaatttttttttttttttacttcataggccaggcttgaagttctgaacactttgaagtctccaattatgagagatccagtctaagcctctggcctgctaattagcaataagtgctttatttggaaggagggagtcatccactcttgagccactgcagtgaagtcacttgatctcagtctgggggaaaacacttcaatagctaaacattctagctttgatttttctgaagggaatacacttgttttcaattttggggtttttctttggggcacttgcttgactctgtatgaacttgtgatccaaggaaaaaggagaaagaacagtgttggcttttaaaatcaggatggttttatgtttgctacgaaataaggcaagaataaaaaattcttatttttaaaaaaaaaaaaaa

SEQ ID NO: 62 - protein, 142 aa, Homo sapiens
  GenBank Accession No. NP_004796
MAAGGSDPRAGDVEEDASQLIFPKEFETAETLLNSEVHMLLEHRKQQNESAEDEQELSEVFMKTLNYTARFSRFKNRETIASVRSLLLQKKLHKFELACLANLCPETAEESKALIPSLEGRFEDEELQQILDDIQTKRSFQY

SEQ ID NO: 63 - DNA, 2806 bp, Homo sapiens
  GenBank Accession No. NM_001248
gagctgacacctccttagcgctggccgcgggccgcctctgcggcagcgctagtcgccttctccgaatcggctccgcacagctaggagaaaagatgttcactgtgctgacccgccaaccatgtgagcaagcaggcctcaaggccctctaccgaactccaaccatcattgccttggtggtcttgcttgtgagtattgtggtacttgtgagtatcactgtcatccagatccacaagcaagaggtcctccctccaggactgaagtatggtattgtgctggatgccgggtcttcaagaaccacagtctacgtgtatcaatggccagcagaaaaagagaataataccggagtggtcagtcaaaccttcaaatgtagtgtgaaaggctctggaatctccagctatggaaataacccccaagatgtccccagagcctttgaggagtgtatgcaaaaagtcaaggggcaggttccatcccacctccacggatccacccccattcacctgggagccacggctgggatgcgcttgctgaggttgcaaaatgaaacagcagctaatgaagtccttgaaagcatccaaagctacttcaagtcccagccctttgactttaggggtgctcaaatcatttctgggcaagaagaaggggtatatggatggattacagccaactatttaatgggaaatttcctggagaagaacctgtggcacatgtgggtgcacccgcatggagtggaaaccacgggtgccctggacttaggtggtgcctccacccaaatatccttcgtggcaggagagaagatggatctgaacaccagcgacatcatgcaggtgtccctgtatggctacgtatacacgctctacacacacagcttccagtgctatggccggaatgaggctgagaagaagtttctggcaatgctcctgcagaattctcctaccaaaaaccatctcaccaatccctgttaccctcgggattatagcatcagcttcaccatgggccatgtatttgatagcctgtgcactgtggaccagaggccagaaagttataaccccaatgatgtcatcacttttgaaggaactggggacccatctctgtgtaaggagaaggtggcttccatatttgacttcaaagcttgccatgatcaagaaacctgttcttttgatggggtttatcagccaaagattaaagggccatttgtggcttttgcaggattctactacacagccagtgctttaaatctttcaggtagcttttccctggacaccttcaactccagcacctggaatttctgctcacagaattggagtcagctcccactgctgctccccaaatttgatgaggtatatgcccgctcttactgcttctcagccaactacatctaccacttgtttgtgaacggttacaaattcacagaggagacttggccccaaatacactttgaaaaagaagtggggaatagcagcatagcctggtctcttggctacatgctcagcctgaccaaccagatcccagctgaaagccctctgatccgtctgcccatagaaccacctgtctttgtgggcaccctcgctttcttcacagcggcagccttgctgtgtctggcatttcttgcatacctgtgttcagcaaccagaagaaagaggcactccgagcatgcctttgaccatgcagtggattctgactgagccttcaaagcagctcctggagtccaatggctgcttagagtcagcctgggtggcaccaggcaatgcaggtgaagtggctgccttcaggaaatacaactaactaaaatcaaacacctaggtcacgtgcctctcaaatactgatttctgccacagcacctcttgaggcatcccttggctattctgtgcatattgttcttcagagacctcactacccacatgctgatctattggggaacagagaagagacaggccacgaaggtcaggctctttatattaagttccccagaggaagagtaagttgagaaggtatcagtttaatgttgaagaattgacctcagggctcagtttccatttccctccctcagtattcttcctggcaagatacccattaagcatttcgccaatcagaatctcattttatagtttttcccattggtctttaactaagactttcttgtagcaatctcgtaagcagtgaaccccctcagatcagtagaatatagtatctgggggagaagacttacttccttcagggcagcagccacagccaggcttctgtcatacaggtagatcccgaagcacagagacataaaaaaggtctcccagaaaactatagaccattctccaagtggaattcccacttagggctctggtcactagattgcaacctgtgtgtttgtcatcatcctcatctcaccattgtattgctatgccctcccataaaaacacattgatccctagcaagattattgcattccagattttactgcctttgctaggcttttgcttagcaaagggctgactttccattgttatcatggtgtatatatttttgtcaccattcccacaagtatacttgatgttgtcatagaacgaacatcctactctatgatttactaaccaattactttcccagatcatagacctctctgcatagtagtcataggtcttgactttggggaaagaaaaggaagctgcaggaatatttatctccaaagtcgaatgagaaagaactccagcaaatccaatggctacaaactaaaaatcagcattatttcatattgctgtttcttagctgaatatggaataaagaactattattttattttgaaaaaaaaaaaaaa

SEQ ID NO: 64 - protein, 529 aa, Homo sapiens
  GenBank Accession No. NP_001239
MFTVLTRQPCEQAGLKALYRTPTIIALVVLLVSIVVLVSITVIQIHKQEVLPPGLKYGIVLDAGSSRTTVYVYQWPAEKENNTGVVSQTFKCSVKGSGISSYGNNPQDVPRAFEECMQKVKGQVPSHLHGSTPIHLGATAGMRLLRLQNETAANEVLESIQSYFKSQPFDFRGAQIISGQEEGVYGWITANYLMGNFLEKNLWHMWVHPHGVETTGALDLGGASTQISFVAGEKMDLNTSDIMQVSLYGYVYTLYTHSFQCYGRNEAEKKFLAMLLQNSPTKNHLTNPCYPRDYSISFTMGHVFDSLCTVDQRPESYNPNDVITFEGTGDPSLCKEKVASIFDFKACHDQETCSFDGVYQPKIKGPFVAFAGFYYTASALNLSGSFSLDTFNSSTWNFCSQNWSQLPLLLPKFDEVYARSYCFSANYIYHLFVNGYKFTEETWPQIHFEKEVGNSSIAWSLGYMLSLTNQIPAESPLIRLPIEPPVFVGTLAFFTAAALLCLAFLAYLCSATRRKRHSEHAFDHAVDSD

SEQ ID NO: 65 - DNA, 1471 bp, Homo sapiens
  GenBank Accession No. NM_000946
ccgccggccgtgctgttcccgccaattcctgtggtaatccttaccgtggcgagttccgcgctcaatggagacgtttgaccccaccgagctgcccgagctgcttaaactttattaccggaggctctttccctactctcagtactatcgctggctcaactacggtggagtgataaagaattactttcaacaccgtgaattttcattcacattgaaagatgatatttacattcgctaccaatccttcaacaaccagagtgatctggaaaaggagatgcagaaaatgaatccatacaagattgatataggcgcagtatattctcacagacccaatcaacacaatacagtgaagctgggagctttccaggctcaggaaaaagaactggtatttgacattgacatgacagactatgacgatgtgaggagatgttgtagttctgcagacatatgtcctaagtgctggaccctcatgacaatggccatacgcatcattgacagagcattgaaggaggactttggatttaagcatcgtctctgggtatattctggaaggagaggtgttcattgttgggtctgtgatgaatcagttagaaaactgtcttctgcagtacgttctgggatagttgagtatttgagccttgtaaagggtggtcaagacgttaaaaagaaagttcacctaagtgaaaaaattcacccttttatcagaaaatctataaacataataaaaaaatactttgaagaatatgccttggttaatcaagatattctcgaaaataaagaaagctgggataagattttagcccttgttcctgaaacaattcatgatgaacttcaacaaagcttccaaaagtctcacaattcacttcagcgttgggagcacttgaagaaagtagccagcagatatcagaataacatcaaaaatgacaaatatggaccctggctggagtgggagattatgctccagtactgttttccacggctggatatcaatgtcagcaaaggaatcaatcatctactgaagagcccttttagtgttcatcctaaaacaggtcgcatatctgtgcctattgatttgcagaaagtggaccagtttgatccatttactgttccgaccataagcttcatctgccgtgaattggatgccatttccactaatgaagaggaaaaagaggagaatgaagctgaatctgatgtcaaacatagaaccagagattataagaagaccagtctagcaccttatgtgaaagtttttgaacattttcttgaaaatctggataaatcccgaaaaggagaacttcttaagaagagtgatttacaaaaagatttctgaagacagagctcctcaaaccattgtggatatcttctgccttcaaccacagatcaaatacttcaagagccatttaataaatatggcagaactatatatgtgtcttaaacctcaaagtaaattttccttgagaaataaaaaaaaaaa

SEQ ID NO: 66 - protein, 420 aa, Homo sapiens
  GenBank Accession No. NP_000937
METFDPTELPELLKLYYRRLFPYSQYYRWLNYGGVIKNYFQHREFSFTLKDDIYIRYQSFNNQSDLEKEMQKMNPYKIDIGAVYSHRPNQHNTVKLGAFQAQEKELVFDIDMTDYDDVRRCCSSADICPKCWTLMTMAIRIIDRALKEDFGFKHRLWVYSGRRGVHCWVCDESVRKLSSAVRSGIVEYLSLVKGGQDVKKKVHLSEKIHPFIRKSINIIKKYFEEYALVNQDILENKESWDKILALVPETIHDELQQSFQKSHNSLQRWEHLKKVASRYQNNIKNDKYGPWLEWEIMLQYCFPRLDINVSKGINHLLKSPFSVHPKTGRISVPIDLQKVDQFDPFTVPTISFICRELDAISTNEEEKEENEAESDVKHRTRDYKKTSLAPYVKVFEHFLENLDKSRKGELLKKSDLQKDF

SEQ ID NO: 67 - DNA, 821 bp, Homo sapiens
  GenBank Accession No. NM_006232
tccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagggcaagaagtttgaccgagtgtctcgactgcattgtgagagtgaatctttcaagatggatctaatcttagatgtaaacattcaaatttaccctgtagacttgggtgacaagttccggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcccctcccctttttgtaaaaagtccatttactgt

SEQ ID NO: 68 - protein, 150 aa, Homo sapiens
  GenBank Accession No. NP_006223
MAGILFEDIFDVKDIDPEGKKFDRVSRLHCESESFKMDLILDVNIQIYPVDLGDKFRLVIASTLYEDGTLDDGEYNPTDDRPSRADQFEYVMYGKVYRIEGDETSTEAATRLSAYVSYGGLLMRLQGDANNLHGFEVDSRVYLLMKKLAF

SEQ ID NO: 69 - DNA, 1659 bp, Homo sapiens
  GenBank Accession No. NM_001953
cgactgccgagctccgccctccaggcggccccacccgcctgccgtcctggggcgccgccgccccgccgccggcagtggaccgctgtgcgcgaaccctgaaccctacggtcccgacccgcgggcgaggccgggtacctgggctgggatccggagcaagcgggcgagggcagcgccctaagcaggcccggagcgatggcagccttgatgaccccgggaaccggggccccacccgcgcctggtgacttctccggggaagggagccagggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggcccagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaa

SEQ ID NO: 70 - protein, 482 aa, Homo sapiens
  GenBank Accession No. NP_001944
MAALMTPGTGAPPAPGDFSGEGSQGLPDPSPEPKQLPELIRMKRDGGRLSEADIRGFVAAVVNGSAQGAQIGAMLMAIRLRGMDLEETSVLTQALAQSGQQLEWPEAWRQQLVDKHSTGGVGDKVSLVLAPALAACGCKVPMISGRGLGHTGGTLDKLESIPGFNVIQSPEQMQVLLDQAGCCIVGQSEQLVPADGILYAARDVTATVDSLPLITASILSKKLVEGLSALVVDVKFGGAAVFPNQEQARELAKTLVGVGASLGLRVAAALTAMDKPLGRCVGHALEVEEALLCMDGAGPPDLRDLVTTLGGALLWLSGHAGTQAQGAARVAAALDDGSALGRFERMLAAQGVDPGLARALCSGSPAERRQLLPRAREQEELLAPADGTVELVRALPLALVLHELGAGRSRAGEPLRLGVGAELLVDVGQRLRRGTPWLRVHRDGPALSGPQSRALQEALVLSDRAPFAAPSPFAELVLPPQQ

SEQ ID NO: 71 - DNA, 3285 bp, Homo sapiens
  GenBank Accession No. NM_006467
actccgcggtcctggtgccgcgtgcaggtcggtgcgcgcttctcccgaggtggaacgggcggcagtcaagcgccggcgttctctgccgtcaccctttccttgccggccggcacttcggctgcagagttttgcccacgcttcgagacttagggagcagtgcctttcagaatttgcccactcatctggtataactggttctgatggctgggaataaaggaagaggacgtgctgcttatacctttaatattgaggctgttggatttagcaaaggtgaaaagttacctgatgtagtgttgaaaccacccccactatttcctgatacagattataaaccagtgccactgaaaacaggagaaggtgaagaatatatgctggctttgaaacaggagttgagagaaacaatgaaaagaatgccttattttattgaaacacctgaagaaagacaagatattgaaaggtatagtaaaagatacatgaaggtatacaaggaagaatggataccagattggagaagacttccaagagagatgatgccaagaaataaatgtaaaaaagcaggcccaaaacccaaaaaggcaaaagacgcaggcaaaggcacaccactcactaatactgaagatgtgttgaaaaaaatggaggaattggaaaaaagaggtgatggtgaaaaatcagatgaggaaaatgaagagaaagaaggaagcaaagagaaaagtaaagaaggtgatgatgacgatgacgatgatgccgcagaacaggaggaatatgatgaagaagagcaagaagaggaaaatgactacattaattcatactttgaagatggagatgattttggcgcagacagtgatgacaacatggatgaggcaacctattaggcatgaaatttttcaaaaaatatttttatgatgcagcttctgaacatttggacagacttgatttgtattttatttctgataaggaataagtacttgtttctgttgttttggacaaatagttgttaccaaaatattcaaaaccactttgagtttacatactagttaccttaaaaattattccctgacactctgacattccttctaaacacctctgccatctctcttatgtactctcatgggtttttttgtatgatttgaatatgaatgtgcctaaagaatttttgctctcttaatctatgtatacatacttgaacaaatcattcttgcttaactgctgatcttttgtaaaactattgctagtcataatggatttctataacctgaaagttgatataatacagcacgtggagcactttaaaaacaaagaaacttgaaaataattttattttttacctttacatggtgtgttctagactactgcattatgactacataaacctacctgagctcttacaagtacagaattgtgagacagaggttttgtgatggaaaacatacacatagggaaaaataccaaactgagcaatataaatttcacagctcacatcttagccagtacaaagaaactttcacatggggtgaatattataatacttgaatttgagacttaatactgtatatgaattaatcatcccactgtaataactgacatcttcaaatagttgggcttatgaaaaatttgactaagacattttattttatactttatgtaaatgtgaaataagttctggtcatataaatatgtagaatgcatgtgtgtgaactctatgaagtgaagtgtggtggccttttatgtttcagagtactcaagtgtacaattgatttatataaaaatgcaaaatgaactcaggtcattttgaaattaatattaatatttttgttgtttaactttaaagctagctcccctaactttatatattttttgggaaaaaatacctaaaaacctcagcctacaaagactctcagaaatgccaaagattttcaaggaaattcatattatatatttcaaaaatgatttatcaatgttatctaccaaaagaaataattttatttttcccctttggggagatattatcctctaatatgagaatcagatccctagattctatttctacctatactattaaactcaaccttgaacctgagcttggttgtttctgtgccttagtttctccactcgtaaacaatttcctataaaaattgtttaaacaccaaccaaaatttaccatatgtattcattctcttgccttaaagatcacttcttaacttacatttggctctcaccctctaaaaatttgtagtttggagagtaactgaaagcacaattttaagaaacatgttttcctcacaaaatatattgtaatctgattttcctatcttgtattcatgcagaaaattggagaaaatgtgtattgtcttgtgccattctgcaatatgaatttctcaggaaaaagatgtttcaatggcaatactttcttaaataattcaagatgggtgtgaggacctatcttattagtttagtgctgtgttaaccatttgtgaattacttcttgtttaaaggaagttgtcaaaaaattttaagattctaaatggaatacacgaataaagtaagccttagaatagaaacctcacaaaaagttgtcatttgcggttgataattaacataggtgttttattctctcaactccttagtaccagagccaaatacaatttagttttcagaaatcttatcaatattgttctatttacctacttataaatctgcagataaccacttgaaccaggcaaatacactgaagataaaggttatttctttttttagctttgaatttgtcatgaccattttagtcttgcagatagcagggcagccccttggggcaaggatttactctgggaggtaccgttaagagccttctttccccctttgaaagatccttttacaatgttaaagtatactagttgcaagaacaagcaggatttgcaggttgctttaccagcatgagtctcatttttctggcttaaaatctgggactgtgaaattattccataggaaagtgaatgttattttgcagaattagcctcttacataaaagtatttgttgaagtgtctttaaaattgctatcatgagcaaaactggttgctgtaatgcttgtttttctgtatttatttacacattaaattcttacaaaacaaaatgtgttcgtttgttttatagtaagatgttttattttgaacttatttaaatgtttatttgttagagaaaactaatttgttaatatagatcttaactagtaactattaagcagggatgtttgttccaaatattcttgaataaacaatcaccacaaacaa

SEQ ID NO: 72 - protein, 223 aa, Homo sapiens
  GenBank Accession No. NP_006458
MAGNKGRGRAAYTFNIEAVGFSKGEKLPDVVLKPPPLFPDTDYKPVPLKTGEGEEYMLALKQELRETMKRMPYFIETPEERQDIERYSKRYMKVYKEEWIPDWRRLPREMMPRNKCKKAGPKPKKAKDAGKGTPLTNTEDVLKKMEELEKRGDGEKSDEENEEKEGSKEKSKEGDDDDDDDAAEQEEYDEEEQEEENDYINSYFEDGDDFGADSDDNMDEATY

SEQ ID NO: 73 - DNA, 981 bp, Homo sapiens
  GenBank Accession No. NM_021173
gggggaggcgtccctccctggaccccggcgacttcctctctcggtttgtctgggtcatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctaggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaaaaaaaaaaaaaaaaaaaaaaaaaaaaaa

SEQ ID NO: 74 - protein, 107 aa, Homo sapiens
  GenBank Accession No. NP_066996
MGRKRLITDSYPVVKRREGPAGHSKGELAPELGEEPQPRDEEEAELELLRQFDLAWQYGPCTGITRLQRWCRAKQMGLEPPPEVWQVLKTHPGDPRFQCSLWHLYPL

SEQ ID NO: 75 - DNA, 2042 bp, Homo sapiens
  GenBank Accession No. NM_001012732
agggcttcgggcccccggggccagccgccgtcctgcgaacgcgcggcgcccgggccgctgcccccttccggccccgcggcggccccgcctcctcccccgacttccttccctgagcacggcggcggcggggacgagcaccggcctgcgcgcggagccggcaccggatggtgggcgggggccagccgtgcggacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttagggtttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttcatgagtttttattttgtctctgagattttgtattccacattctagggtattctgtaatttggctccttaccaatattattaaaatcttattaaaatctaccctaccaaagca

SEQ ID NO: 76 - protein, 189 aa, Homo sapiens
  GenBank Accession No. NP_001012750
MVGGGQPCGPNMSEVSCKKRDDYLEWPEYFMAVAFLSAQRSKDPNSQVGACIVNSENKIVGIGYNGMPNGCSDDVLPWRRTAENKLDTKYPYVCHAELNAIMNKNSTDVKGCSMYVALFPCNECAKLIIQAGIKEVIFMSDKYHDSDEATAARLLFNMAGVTFRKFIPKCSKIVIDFDSINSRPSQKLQ

SEQ ID NO: 77 - DNA, 7108 bp, Homo sapiens
  GenBank Accession No. NM_004341
gcgcgcccgaggctcctacgctgccgcgcccggcttctctccagcgccccgcgccgttagccacgtggaccgactccggcgcgccgtcctcacgtggttccagtggagtttgcagtccttcccgcttctccgtactcgcccccgcctctgagctcccttcccatggcggccctagtgttggaggacgggtcggtcctgcggggccagccctttggggccgccgtgtcgactgccggggaagtggtgtttcaaaccggcatggtcggctaccccgaggccctcactgatccctcctacaaggcacagatcttagtgctcacctatcctctgatcggcaactatggcatccccccagatgaaatggatgagttcggtctctgcaagtggtttgaatcctcgggcatccacgtagcagcactggtagtgggagagtgctgtcctactcccagccactggagtgccacccgcaccctgcatgagtggctgcagcagcatggcatccctggcttgcaaggagtagacactcgggagctgaccaagaagttgcgggaacaggggtctctgctggggaagctggtccagaatggaacagaaccttcatccctgccattcttggaccccaatgcccgccccctggtaccagaggtctccattaagactccacgggtattcaatacagggggtgcccctcggatccttgctttggactgtggcctcaagtataatcagatccgatgcctctgccagcgtggggctgaggtcactgtggtaccctgggaccatgcactagacagccaagagtatgagggtctcttcttaagtaatgggcctggtgaccctgcctcctatcccagtgtcgtatccacactgagccgtgttttatctgagcctaatccccgacctgtctttgggatctgcctgggacaccagctattggccttagccattggggccaagacttacaagatgagatatgggaaccgaggccataaccagccctgcttgttggtgggctctgggcgctgctttctgacatcccagaaccatgggtttgctgtggagacagactcactgccagcagactgggctcctctcttcaccaacgccaatgatggttccaatgaaggcattgtgcacaacagcttgcctttcttcagtgtccagtttcacccagagcaccaagctggcccttcagatatggaactgcttttcgatatctttctggaaactgtgaaagaggccacagctgggaaccctgggggccagacagttagagagcggctgactgagcgcctctgtccccctgggattcccactcccggctctggacttccaccaccacgaaaggttctgatcctgggctcagggggcctctccattggccaagctggagaatttgactactcgggctctcaggcaattaaggccctgaaggaggaaaacatccagacgttgctgatcaaccccaatattgccacagtgcagacctcccaggggctggccgacaaggtctattttcttcccataacacctcattatgtaacccaggtgatacgtaatgaacgccccgatggtgtgttactgacttttgggggccagactgctctgaactgtggtgtggagctgaccaaggccggggtgctggctcggtatggggtccgggtcctgggcacaccagtggagaccattgagctgaccgaggatcgacgggcctttgctgccagaatggcagagatcggagagcatgtggccccgagcgaggcagcaaattctcttgaacaggcccaggcagccgctgaacggctggggtaccctgtgctagtgcgtgcagcctttgccctgggtggcctgggctctggctttgcctctaacagggaggagctctctgctctcgtggccccagcttttgcccataccagccaagtgctagtagacaagtctctgaagggatggaaggagattgagtacgaggtggtgagagacgcctatggcaactgtgtcacggtgtgtaacatggagaacttggacccactgggcatccacactggtgagtccatagtggtggcccctagccagacactgaatgacagggagtatcagctcctgaggcagacagctatcaaggtgacccagcacctgggaattgttggggagtgcaatgtgcagtatgccttgaaccctgagtctgagcagtattacatcattgaagtgaatgccaggctctctcgcagctctgccctggccagtaaggccacaggttatccactggcttatgtggcagccaagctagcattgggcatccctttgcctgagctcaggaactctgtgacagggggtacagcagcctttgaacccagcgtggattattgtgtggtgaagattcctcgatgggaccttagcaagttcctgcgagtcagcacaaagattgggagctgcatgaagagcgttggtgaagtcatgggcattgggcgttcatttgaggaggccttccagaaggccctgcgcatggtggatgagaactgtgtgggctttgatcacacagtgaaaccagtcagcgatatggagttggagactccaacagataagcggatttttgtggtggcagctgctttgtgggctggttattcagtggaccgcctgtatgagctcacacgcatcgaccgctggttcctgcaccgaatgaagcgtatcatcgcacatgcccagctgctagaacaacaccgtggacagcctttgccgccagacctgctgcaacaggccaagtgtcttggcttctcagacaaacagattgcccttgcagttctgagcacagagctggctgttcgcaagctgcgtcaggaactggggatctgtccagcagtgaaacagattgacacagttgcagctgagtggccagcccagacaaattacctatacctaacgtattggggcaccacccatgacctcacctttcgaacacctcatgtcctagtccttggctctggcgtctaccgtattggctctagcgttgaatttgactggtgtgctgtaggctgcatccagcagctccgaaagatgggatataagaccatcatggtgaactataacccagagacagtcagcaccgactatgacatgtgtgatcgactctactttgatgagatctcttttgaggtggtgatggacatctatgagctcgagaaccctgaaggtgtgatcctatccatgggtggacagctgcccaacaacatggccatggcgttgcatcggcagcagtgccgggtgctgggcacctcccctgaagccattgactcggctgagaaccgtttcaagttttcccggctccttgacaccattggtatcagccagcctcagtggagggagctcagtgacctcgagtctgctcgccaattctgccagaccgtggggtacccctgtgtggtgcgcccctcctatgtgctgagcggtgctgctatgaatgtggcctacacggatggagacctggagcgcttcctgagcagcgcagcagccgtctccaaagagcatcccgtggtcatctccaagttcatccaggaggctaaggagattgacgtggatgccgtggcctctgatggtgtggtggcagccatcgccatctctgagcatgtggagaatgcaggtgtgcattcaggtgatgcgacgctggtgacccccccacaagatatcactgccaaaaccctggagcggatcaaagccattgtgcatgctgtgggccaggagctacaggtcacaggacccttcaatctgcagctcattgccaaggatgaccagctgaaagttattgaatgcaacgtacgtgtctctcgctccttccccttcgtttccaagacactgggtgtggacctagtagccttggccacgcgggtcatcatgggggaagaagtggaacctgtggggctaatgactggttctggagtcgtgggagtaaaggtgcctcagttctccttctcccgcttggcgggtgctgacgtggtgttgggtgtggaaatgaccagtactggggaggtggccggctttggggagagccgctgtgaggcatacctcaaggccatgctaagcactggctttaagatccccaagaagaatatcctgctgaccattggcagctataagaacaaaagcgagctgctcccaactgtgcggctactggagagcctgggctacagcctctatgccagtctcggcacagctgacttctacactgagcatggcgtcaaggtaacagctgtggactggcactttgaggaggctgtggatggtgagtgcccaccacagcggagcatcctggagcagctagctgagaaaaactttgagctggtgattaacctgtcaatgcgtggagctgggggccggcgtctctcttcctttgtcaccaagggctaccgcacccgacgcttggccgctgacttctccgtgcccctaatcatcgatatcaagtgcaccaaactctttgtggaggccctaggccagatcgggccagcccctcctttgaaggtgcatgttgactgtatgacctcccaaaagcttgtgcgactgccgggattgattgatgtccatgtgcacctgcgggaaccaggtgggacacataaggaggactttgcttcaggcacagccgctgccctggctgggggtatcaccatggtgtgtgccatgcctaatacccggccccccatcattgacgcccctgctctggccctggcccagaagctggcagaggctggcgcccggtgcgactttgcgctattccttggggcctcgtctgaaaatgcaggaaccttgggcaccgtggccgggtctgcagccgggctgaagctttacctcaatgagaccttctctgagctgcggctggacagcgtggtccagtggatggagcatttcgagacatggccctcccacctccccattgtggctcacgcagagcagcaaaccgtggctgctgtcctcatggtggctcagctcactcagcgctcagtgcacatatgtcacgtggcacggaaggaggagatcctgctaattaaagctgcaaaggcacggggcttgccagtgacctgcgaggtggctccccaccacctgttcctaagccatgatgacctggagcgcctggggcctgggaagggggaggtccggcctgagcttggctcccgccaggatgtggaagccctgtgggagaacatggctgtcatcgactgctttgcctcagaccatgctccccataccttggaggagaagtgtgggtccaggcccccacctgggttcccagggttagagaccatgctgccactactcctgacggctgtaagcgagggccggctcagcctggacgacctgctgcagcgattgcaccacaatcctcggcgcatctttcacctgcccccgcaggaggacacctatgtggaggtggatctggagcatgagtggacaattcccagccacatgcccttctccaaggcccactggacaccttttgaagggcagaaagtgaagggcaccgtccgccgtgtggtcctgcgaggggaggttgcctatatcgatgggcaggttctggtacccccgggctatggacaggatgtacggaagtggccacagggggctgttcctcagctcccaccctcagcccctgccactagtgagatgaccacgacacctgaaagaccccgccgtggcatcccagggcttcctgatggccgcttccatctgccgccccgaatccatcgagcctccgacccaggtttgccagctgaggagccaaaggagaagtcctctcggaaggtagccgagccagagctgatgggaacccctgatggcacctgctaccctccaccaccagtaccgagacaggcatctccccagaacctggggacccctggcttgctgcacccccagacctcacccctgctgcactcattagtgggccaacatatcctgtccgtccagcagttcaccaaggatcagatgtctcacctgttcaatgtggcacacacactgcgtatgatggtgcagaaggagcggagcctcgacatcctgaaggggaaggtcatggcctccatgttctatgaagtgagcacacggaccagcagctcctttgcagcagccatggcccggctgggaggtgctgtgctcagcttctcggaagccacatcgtccgtccagaagggcgaatccctggctgactccgtgcagaccatgagctgctatgccgacgtcgtcgtgctccggcacccccagcctggagcagtggagctggccgccaagcactgccggaggccagtgatcaatgctggggatggggtcggagagcaccccacccaggccctgctggacatcttcaccatccgtgaggagctgggaactgtcaatggcatgacgatcacgatggtgggtgacctgaagcacggacgcacagtacattccctggcctgcctgctcacccagtatcgtgtcagcctgcgctacgtggcacctcccagcctgcgcatgccacccactgtgcgggccttcgtggcctcccgcggcaccaagcaggaggaattcgagagcattgaggaggcgctgcctgacactgatgtgctctacatgactcgaatccagaaggaacgatttggctctacccaggagtacgaagcttgctttggtcagttcatcctcactccccacatcatgacccgggccaagaagaagatggtggtgatgcacccgatgccccgtgtcaacgagataagcgtggaagtggactcggatccccgcgcagcctacttccgccaggctgagaacggcatgtacatccgcatggctctgttagccaccgtgctgggccgtttctagggcctggcttcctcagcctcttctctttaggcccagctgctgggcaaggaattccagtgcctcctacgggggcagcacacttagatattcctggacatccagatagctcacatgtgctgaccacacttcaggctctggactggagctctctggcatgggggtggggcctcagatgctggggcccagtctgccccatcttcattcctgcaccttaaacctgtacagtcatttttctactgacttaataaacagccgagctgtcccttga

SEQ ID NO: 78 - protein, 2225 aa, Homo sapiens
  GenBank Accession No. NP_004332 1
MAALVLEDGSVLRGQPFGAAVSTAGEVVFQTGMVGYPEALTDPSYKAQILVLTYPLIGNYGIPPDEMDEFGLCKWFESSGIHVAALVVGECCPTPSHWSATRTLHEWLQQHGIPGLQGVDTRELTKKLREQGSLLGKLVQNGTEPSSLPFLDPNARPLVPEVSIKTPRVFNTGGAPRILALDCGLKYNQIRCLCQRGAEVTVVPWDHALDSQEYEGLFLSNGPGDPASYPSVVSTLSRVLSEPNPRPVFGICLGHQLLALAIGAKTYKMRYGNRGHNQPCLLVGSGRCFLTSQNHGFAVETDSLPADWAPLFTNANDGSNEGIVHNSLPFFSVQFHPEHQAGPSDMELLFDIFLETVKEATAGNPGGQTVRERLTERLCPPGIPTPGSGLPPPRKVLILGSGGLSIGQAGEFDYSGSQAIKALKEENIQTLLINPNIATVQTSQGLADKVYFLPITPHYVTQVIRNERPDGVLLTFGGQTALNCGVELTKAGVLARYGVRVLGTPVETIELTEDRRAFAARMAEIGEHVAPSEAANSLEQAQAAAERLGYPVLVRAAFALGGLGSGFASNREELSALVAPAFAHTSQVLVDKSLKGWKEIEYEVVRDAYGNCVTVCNMENLDPLGIHTGESIVVAPSQTLNDREYQLLRQTAIKVTQHLGIVGECNVQYALNPESEQYYIIEVNARLSRSSALASKATGYPLAYVAAKLALGIPLPELRNSVTGGTAAFEPSVDYCVVKIPRWDLSKFLRVSTKIGSCMKSVGEVMGIGRSFEEAFQKALRMVDENCVGFDHTVKPVSDMELETPTDKRIFVVAAALWAGYSVDRLYELTRIDRWFLHRMKRIIAHAQLLEQHRGQPLPPDLLQQAKCLGFSDKQIALAVLSTELAVRKLRQELGICPAVKQIDTVAAEWPAQTNYLYLTYWGTTHDLTFRTPHVLVLGSGVYRIGSSVEFDWCAVGCIQQLRKMGYKTIMVNYNPETVSTDYDMCDRLYFDEISFEVVMDIYELENPEGVILSMGGQLPNNMAMALHRQQCRVLGTSPEAIDSAENRFKFSRLLDTIGISQPQWRELSDLESARQFCQTVGYPCVVRPSYVLSGAAMNVAYTDGDLERFLSSAAAVSKEHPVVISKFIQEAKEIDVDAVASDGVVAAIAISEHVENAGVHSGDATLVTPPQDITAKTLERIKAIVHAVGQELQVTGPFNLQLIAKDDQLKVIECNVRVSRSFPFVSKTLGVDLVALATRVIMGEEVEPVGLMTGSGVVGVKVPQFSFSRLAGADVVLGVEMTSTGEVAGFGESRCEAYLKAMLSTGFKIPKKNILLTIGSYKNKSELLPTVRLLESLGYSLYASLGTADFYTEHGVKVTAVDWHFEEAVDGECPPQRSILEQLAEKNFELVINLSMRGAGGRRLSSFVTKGYRTRRLAADFSVPLIIDIKCTKLFVEALGQIGPAPPLKVHVDCMTSQKLVRLPGLIDVHVHLREPGGTHKEDFASGTAAALAGGITMVCAMPNTRPPIIDAPALALAQKLAEAGARCDFALFLGASSENAGTLGTVAGSAAGLKLYLNETFSELRLDSVVQWMEHFETWPSHLPIVAHAEQQTVAAVLMVAQLTQRSVHICHVARKEEILLIKAAKARGLPVTCEVAPHHLFLSHDDLERLGPGKGEVRPELGSRQDVEALWENMAVIDCFASDHAPHTLEEKCGSRPPPGFPGLETMLPLLLTAVSEGRLSLDDLLQRLHHNPRRIFHLPPQEDTYVEVDLEHEWTIPSHMPFSKAHWTPFEGQKVKGTVRRVVLRGEVAYIDGQVLVPPGYGQDVRKWPQGAVPQLPPSAPATSEMTTTPERPRRGIPGLPDGRFHLPPRIHRASDPGLPAEEPKEKSSRKVAEPELMGTPDGTCYPPPPVPRQASPQNLGTPGLLHPQTSPLLHSLVGQHILSVQQFTKDQMSHLFNVAHTLRMMVQKERSLDILKGKVMASMFYEVSTRTSSSFAAAMARLGGAVLSFSEATSSVQKGESLADSVQTMSCYADVVVLRHPQPGAVELAAKHCRRPVINAGDGVGEHPTQALLDIFTIREELGTVNGMTITMVGDLKHGRTVHSLACLLTQYRVSLRYVAPPSLRMPPTVRAFVASRGTKQEEFESIEEALPDTDVLYMTRIQKERFGSTQEYEACFGQFILTPHIMTRAKKKMVVMHPMPRVNEISVEVDSDPRAAYFRQAENGMYIRMALLATVLGRF

SEQ ID NO: 79 - DNA, 1616 bp, Homo sapiens
  GenBank Accession No. NM_006230
aggcgcgcggggattggcgggatgcggcgcgccgcgcgtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcgaaaaaaaaaaaaaaa

SEQ ID NO: 80 - protein, 469 aa, Homo sapiens
  GenBank Accession No. NP_006221
MFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 81 - DNA, 1616 bp, Homo sapiens
  GenBank Accession No. NM_003258
gcgcacgtcccggattcctcccacgagggggcgggctgcggccaaatctcccgccaggtcagcggccgggcgctgattggccccatggcggcggggccggctcgtgattggccagcacgccgtggtttaaagcggtcggcgcgggaaccaggggcttactgcgggacggccttggagagtactcgggttcgtgaacttcccggaggcgcaatgagctgcattaacctgcccactgtgctgcctggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccggaacaccatggaggcactgcccgcctgcctgctccgagacgtggcccaggaggccctgggcgtggctgtcataggcatcgacgaggggcagtttttccctgacatcgtggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcgagggccgcccgctcccttcctgccactgccgcctactggacgctgccctgcatgctgcccagccactccaggaggaagtcgggaggcgtggagggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctctccttggggtgagggacagagccccacgctgttgacatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaattgaaaattcactggttggtggaaaaaaaaaaaaaaaaaaaaaa

SEQ ID NO: 82 - protein, 234 aa, Homo sapiens
  GenBank Accession No. NP_003249
MSCINLPTVLPGSPSKTRGQIQVILGPMFSGKSTELMRRVRRFQIAQYKCLVIKYAKDTRYSSSFCTHDRNTMEALPACLLRDVAQEALGVAVIGIDEGQFFPDIVEFCEAMANAGKTVIVAALDGTFQRKPFGAILNLVPLAESVVKLTAVCMECFREAAYTKRLGTEKEVEVIGGADKYHSVCRLCYFKKASGQPAGPDNKENCPVPGKPGEAVAARKLFAPQQILQCSPAN

SEQ ID NO: 83 - DNA, 1796 bp, Homo sapiens
  GenBank Accession No. NM_003364
ggtcagctgagttcgccggcccagggcaggcggggcccgagcctagcggtaacccccgggcagggcggggccgctcgcagactccatatgagattcacctcgcaggtggttccctcattcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtgggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggataggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaatcccctgttgtgtggactttgagcacactttacacaagaatctagaaaatcagatcgcgattaagagacagagaatcttggattaaccgcatgggagatgttcttccttttgaagtttcattggagcattttcaatgatgttagcctgatttggggtttcttcaagaacattctaccaaatttttgtactatttctagggaaatttttcagactttaaaattctaatggtagtcagatttcatgtcactaaacaagaaatctgacaatagtgccaggaaactaatttcctgatacattaaaaaaattccatgcaaaaaaaaaaaaaaaaaaaa

SEQ ID NO: 84 - protein, 310 aa, Homo sapiens
  GenBank Accession No. NP_003355
MAATGANAEKAESHNDCPVRLLNPNIAKMKEDILYHFNLTTSRHNFPALFGDVKFVCVGGSPSRMKAFIRCVGAELGLDCPGRDYPNICAGTDRYAMYKVGPVLSVSHGMGIPSISIMLHELIKLLYYARCSNVTIIRIGTSGGIGLEPGTVVITEQAVDTCFKAEFEQIVLGKRVIRKTDLNKKLVQELLLCSAELSEFTTVVGNTMCTLDFYEGQGRLDGALCSYTEKDKQAYLEAAYAAGVRNIEMESSVFAAMCSACGLQAAVVCVTLLNRLEGDQISSPRNVLSEYQQRPQRLVSYFIKKKLSKA

SEQ ID NO: 85 - DNA, 3284 bp, Homo sapiens
  GenBank Accession No. NM_001034
cccgtgcaccctgtcccagccgtcctgtcctggctgctcgctctgcttcgctgcgcctccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaaccaactttaaagtcagtcctgtgtatacctagatattagtcagttggtgccagatagaagacaggttgtgtttttatcctgtggcttgtgtagtgtcctgggattctctgccccctctgagtagagtgttgtgggataaaggaatctctcagggcaaggagcttcttaagttaaatcactagaaatttaggggtgatctgggccttcatatgtgtgagaagccgtttcattttatttctcactgtattttcctcaacgtctggttgatgagaaaaaattcttgaagagttttcatatgtgggagctaaggtagtattgtaaaatttcaagtcatccttaaacaaaatgatccacctaagatcttgcccctgttaagtggtgaaatcaactagaggtggttcctacaagttgttcattctagttttgtttggtgtaagtaggttgtgtgagttaattcatttatatttactatgtctgttaaatcagaaattttttattatctatgttcttctagattttacctgtagttcatacttcagtcacccagtgtcttattctggcattgtctaaatctgagcattgtctagggggatcttaaactttagtaggaaaccatgagctgttaatacagtttccattcaaatattaatttcagaatgaaacataatttttttttttttttttgagatggagtctcgctctgttgcccaggctggagtgcagtggcgcgattttggctcactgtaacctccatctcctgggttcaagcaattctcctgtctcagcctccctagtagctgggactgcaggtatgtgctaccacacctggctaatttttgtatttttagtagagatggagtttcaccatattggtcaggctggtcttgaactcctgacctcaggtgatccacccacctcggcctcccaaagtgctgggattgcaggcgtgataaacaaatattcttaatagggctactttgaattaatctgcctttatgtttgggagaagaaagctgagacattgcatgaaagatgatgagagataaatgttgatcttttggccccatttgttaattgtattcagtatttgaacgtcgtcctgtttattgttagttttcttcatcatttattgtatagacaatttttaaatctctgtaatatgatacattttcctatcttttaagttattgttacctaaagttaatccagattatatggtccttatatgtgtacaacattaaaatgaaaggctttgtcttgcattgtgaggtacaggcggaagttggaatcaggttttaggattctgtctctcattagctgaataatgtgaggattaacttctgccagctcagaccatttcctaatcagttgaaagggaaacaagtatttcagtctcaaaattgaataatgcacaagtcttaagtgattaaaataaaactgttcttatgtcagtttcaaaaaaaaaaaaaaaaaa

SEQ ID NO: 86 - protein, 389 aa, Homo sapiens
  GenBank Accession No. NP_001025
MLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 87 - DNA, 6946 bp, Homo sapiens
  GenBank Accession No. NM_006918
atctgccgtcatatcagcttatggcgccggtcgctgattggctggccgctccagcctcccggcccgcttgctggctgcccagctgctaggacagtttgcagagcagtggcgtgcggagcggcggcggaccacctccaggggctaagtgatggatcttgtactccgtgttgcagattactatttttttacaccatacgtgtatccagccacatggccagaagatgacatcttccgacaagctattagtcttctgattgtaacaaatgttggtgcttacatcctttatttcttctgtgcaacactgagctattattttgtcttcgatcatgcattaatgaaacatccacaatttttaaagaatcaagtccgtcgagagattaagtttactgtccaggcattgccatggataagtattcttactgttgcactgttcttgctggagataagaggttacagcaaattacatgatgacctaggagagtttccatatggattgtttgaacttgtcgttagtataatatctttcctctttttcactgacatgttcatctactggattcacagaggccttcatcatagactggtatataagcgcctacataaacctcaccatatttggaagattcctactccatttgcaagtcatgcttttcaccctattgatggctttcttcagagtctaccttaccatatatacccttttatctttccattacacaaggtggtttatttaagtctgtacatcttggttaatatctggacaatttccattcatgacggtgattttcgtgtcccccaaatcttacagccatttattaatggctcagctcatcatacagaccaccatatgttctttgactataattatggacaatatttcactttgtgggataggattggcggctcattcaaaaatccttcatcctttgaggggaagggaccgctcagttatgtgaaggagatgacagagggaaagcgcagcagccattcaggaaatggctgtaagaatgaaaaattattcaatggagagtttacaaagactgaatagattattgcccagttattcttaagtaaggacaaagaaggaaatatcatcgtatttcttttttttaataaggaaaaaataatatccatacagtcaagatacatagtaaatggtatcatttggaaatcagcatcgtgggcactgctgaggaatgatcctagtggtaggtcagaagaagatgctgtgaacaccaggactttaatcttatgcttaaaatgccagatgttgttcgggggacaacttgtatctttctagcagcagatctgtagtttgtatagcctcaacaacaattttaaataagatggagaataaattattgaggggactaggctatatgcatttgccttcatccacccatgtttattaagaatcattgtgcttaataataccaagactaagcaccataaccaagaaatactaatgtaaagattgtttcttgtttcaggaatggttaattcttcaacgttggtatgataatgataacttgttttgacttgaataaagtactacatcagtgtggaaaaaaattctgatacattagcagctatgtaaatgacctaattgatagcaggtgtaataagactatcgtcttcctacacataggaggctcattctctggacacactatcacctattacattttactgattaacaaataaattggaatttaaaaatatcgatatcaccatgatttaatccagatctgggattatgtagctaaacattgtgatgattattatttaaaaccattatttaataagagtaaaaatatgtgaatctggatatatttaaaaaaagaaatttgatgcccagataatatattaggcactactgattttttagttaaattgatgcactacacttttgatgtttgaagttacaaacctgtaatttttttgtaaaggaaataattgccaaatacctaggcccattgctgacgattagttctaaaatcttattcctcctcttctcccctcacttttccctacttcctctgcaaaaagatttaacaaatacattcataaggaaatgtgtgttgtaacaaatatattgcaaaaacatagtttgtaaaggcattctataagctatttatgtaaaatcaataaaagttgatcataattaaactgtatcagttgagtattatagcagcacaaagtattctttgtacagattttgtgccaatttgaagccacagaaatgatgtggattgttaattgtgttttagaacatccccggacactcagtgtcacagggggaaagaagtgggtaccacattctgtttatatttcacattttaactagatttgagtgtttttagcaagaaatcagtcttaaaatctaatgtctgggatccagaagaaaatgtctttaatctgtgagttattgtcacaatgtcatcttatttaaatgtaccaattagcattttgtaataggcaaatgtcatttagtgcttttcaccaatcccactcacccccggtgctccgccttgcctaagaaaaagaaattaaggagaagtaaactttatttcctaatataatgtcagctgatatttattgagcttttcctctttgcccagagactaggacccaaagaagttaagtaactattcccaggtttatttctctctcatatgatgtcccatgtggatgtttgtggtcagtggacagctttccacctagtctttctgcgacccaggctccttcctcttggggctctgcctttctctcagtccatagagccctctttgttgaaagagcacataggaaaagaaggaaaagtctgtgtggaaaatgtttctgggtcaggcctggaagtggtgcatatctcttccgcccatgttcctttggacagaactccgtcacatggcccacctagagagattttgggaaatgtgtccagctgtgtgcctgggaggaagggggcaccattttcttgagcagctagacagtttgccgtatttgtggtgttctcctcttgttgatgttgaaatggtgaatgagccataaagtatttcaggttatccacacactaatcatctcagtgtctttaattcttaactccaatatgaatgtttaaagcttcctctagattcttattcctatataactaatagagaagaaaggacagcttcctatggggaagacagaggcttcctcatagatgttaggaataatcaaacttgcccctgccctttcacccgtctcaaattctggtcttttaaagcagcgttatgttaagtagtcctaacattgtaatatacagtactgccacattctcctactttctattagaggaagtcagagaatatttatggaagtgaggacccaaattaccttctacagatgacttttatagttacaggacagaaagtgaaaatcaaggttacgttttctacttttgtggtagaaattgagaagtgggtggatatggttcgagaagacctttcagaaacacagagactgagtctttgtcttccatgctgtctctgcagtactgagtgaatttccttatacccttgtatcatgttttcctcccatcttctagaagctggggacagatttggaagagaattacacaagttcagttttttgatacatggattttacagtgcatgcaggttatttatgtagagaggaggtctgggagaaagatggaaactagggagatgactgagaacaaagatatttgggattaacacagatagaagaaaagtttgaaaccatgagattgtcacagcatgaaaaaagatattcaaagacactaaccaacttgaggggtgcagtggtctgaatgtgtcctccaaaattcaaatgtggaaatgtatttgccagtgagatagtatgtagaggtggggccttgaggaagtgattaagtcatgagggctctgggattaatgacttaaaaagaggtgtgaggcagctgttcagcccttctgtctcctgtccctttttttttttttttttttgagatggagtcttgctctgttgccccaggctggagtgcagtggcgtgatcttggttcactgcaagctccacctcccgggttcacgccattctcctgcctcagcctcccgagtagctgggactacaggtgcccgccaccaccacgcccggctaattttttatatttttagtagagatggggtttcaccgtgttagccaggatggtcttgatctcctgacctcatgatctgcctgcctcggcctcccaaagtgctgggattataggtgtgagccaccatgcccagccccttctgtcccttctaacgtgaggacccagcaacaaggtaccatcttgaaagcagcaactggggactcagcagacaccaaaccaactggtgcttaaccgtgacttcccagcctccagagctgtaagaaaataaatttctattatttatagattacccagttgaagatactttgttaaggcagtacaaatggactaagacaagggggaagaaatttgcattcctgatcttcccaacttcttcaaattcacaacacttgaatgacagtcttatttcagcacttactgctatcacctattacttttatgtgtgtcttacctatttgagatgccagattccttggaagtagagaccgtgtctgaatcatcattgtattaaaccactcatccttaacaaatgcccaagccatggttaaagttcaataaatactttgttgaatttattaataaaatggcagaaatgtcattctcttccatatatgtttaataaatccctgataggtgctaagcactgcactaggtaaaaattctcttctgatgctgtctttttggccaaccatttttttatcatttattcattagctgacatttgctaagtgctttggaggggtcaaaaggggaagtaatgagaaatcaaagatggtccctacatcaaggataaactatctttttttagtcactcaaagtcataaccctttggaaacaaaacccaccagtaccccagattttgaccacagatgaatcagtactacaaggactggttagagggttgaatgaatctgtatactcagcacttaacacagcactctgggtaaaagaaaaaagatcctcaaagatattagttggttacatcaagaaaggacaaacttaggttaatctataacttcatctcagaggaacaggaactttggagataaacagggctctgccacttgcaagttgcaccatccctggtttctccatctgtaaattgattaaaacactgcctatctaataagattaaataagttagaagcattcagttaaatgtcaactgaaactattgttcatgtaaattgtgcttgatgctttttctttctagattcaatgattattgtcattttacctccataggccctcaatagaaatcagttgcagagggcagaagcctagatattttcaccttaaaattggagggtgaaagacattgaggtgaagtagagatagagggtacacagaaaaatcgtataagtaaaactaacatcgttaacattatttactgtaagttatctttgtaagagtggtaaaatacattgtgttgttaaataatttcatttaaaaaatgcatcactttgtgtgtttttatattgctaaaaccataaggccagtctacaaggtttgtagataaaatagaaacataccttccttgaaaagcagaataaattttttaaaggcaggaaggaagtgtttgaaccatgtgtcaacaagctttactgtcaaagcaggcttttggtatgggaagaaaaatacttataaatacttgttttaatatttgctttattaaaatacatttaaaatacagcatttttaaatctctaagctcaacttgaagatataagaacagtaaatttgataaaaatgagaaattacattcccatttctttaacaatttgtaaattccaattatcctgaacatttaataccatttacatattttattaatcacattttcttaaacatttgataagagatttaatattttgatccaactaccaaaaaagcagacttgtgtacttgacagatttttctaaacacttcacaactcacgattcaaacaaagacaaaatagcatatcaaaagttaatcactcagttggaaagcactcataccataggcttttattcatttcttgaataattttgttatatcttcctcttttaggctgcaatgagctataattgcactactgcactccacgctgggtgacagagcaagaccctatctctaaaaataaaaaagtatatatatataaaaatatcttcctctattataatttaactcattaagccatttatttagatgtaaacttgcccccctgacatgtggtatgaaacaaatagaaacctagaaatttagtgcatattcaaatattaagacagacactggtgtggtgacttttgtctgtcgcttcattgggacgttttttctttctgatcaacttaatgaaattataatttactataattaagtgtagccatttttactgtagagttcaatgatctttgatgaacgtgtacacccatgtaaccaccacccccaatcaaagtaaagaacattttcttaccagaataaatttcctctccgtttgcagtcattctccccagccctaggtcaccactgatccaccttctgttactggaaggttagttttcttccctgatttagaatttcatataaattaaatcagatagtatatactcttgtgtttagtttctttagcttaacatgtttagagatatttgctgttgcctgtgtctgtagctttttgttttcattgctgaatagtatttcattgtaatataccacagttggtttatgtatttgctgatgaatatttgtgttatttccagcgtgggattattatgaataaagttgctacaaacatttgtatacaa

SEQ ID NO: 88 - protein, 299 aa, Homo sapiens
  GenBank Accession No. NP_008849
MDLVLRVADYYFFTPYVYPATWPEDDIFRQAISLLIVTNVGAYILYFFCATLSYYFVFDHALMKHPQFLKNQVRREIKFTVQALPWISILTVALFLLEIRGYSKLHDDLGEFPYGLFELVVSIISFLFFTDMFIYWIHRGLHHRLVYKRLHKPHHIWKIPTPFASHAFHPIDGFLQSLPYHIYPFIFPLHKVVYLSLYILVNIWTISIHDGDFRVPQILQPFINGSAHHTDHHMFFDYNYGQYFTLWDRIGGSFKNPSSFEGKGPLSYVKEMTEGKRSSHSGNGCKNEKLFNGEFTKTE

SEQ ID NO: 89 - DNA, 2241 bp, Homo sapiens
  GenBank Accession No. NM_006745
cccggctccacccccaagccaggcgaggcaggttccgaggttggaacacctggcgagtcctcggtgtcggtggccggcagtcatctcgcggccgttcagaattataaggctgtctgcagagatttgaaaaatggcaacaaatgaaagtgtcagcatctttagttcagcatccttggctgtggaatatgtagattcacttttacctgagaatcctctgcaagaaccatttaaaaatgcttggaactatatgttgaataattatacaaagttccagattgcaacatggggatcccttatagttcatgaagccctttatttcttattctgtttacctggatttttatttcaatttataccttatatgaaaaaatacaaaattcaaaaggataagccagagacatgggaaaaccaatggaagtgtttcaaagttcttctctttaatcacttctgtatccagctgcctttgatttgtggaacctattattttacagagtatttcaatattccttatgattgggaaagaatgccaagatggtattttcttttggcaagatgctttggttgtgcagtcattgaagatacttggcactattttctgcatagactcttacaccacaaaagaatatacaagtatattcataaagttcatcatgagtttcaggctccatttggaatggaagctgaatatgcacatcctttggagactctaattcttggaactggatttttcattggaatcgtgcttttgtgtgatcatgtaattcttctttgggcatgggtgaccattcgtttattagaaactattgatgtccatagtggttatgatattcctctcaaccctttaaatctgatccctttctatgctggttctcggcatcatgatttccaccacatgaacttcattggaaactatgcttcaacatttacatggtgggatcgaatttttggaacagactctcagtataatgcctataatgaaaagaggaagaagtttgagaaaaagactgaataaatatctcacgtaaaccttcctgaaagataaacgttttcctgaattcagaaactagtagctaacattgcttctggagagcagaaataagcatgtcttctggctactaagtgataaaaagaacattaacaacctttaattaccttcctagtgggaactttttctactttacctacaagttctatatatgtagaaatgaataaatatatatttaagtacagttttcatgaggaagttttaaaagaccatgttcctaagcttccaagaaggttttggatactagaagtattaatctatggcttttctcccagtaaaaccataggcctgaagttcacattgggtctttaaatcttttagatatatactggtcatttcagaaaattcttcatagtggtattggccttatatttaactttttttttattttttttttgagacaaagccacactctgtctccttggctggagtgtggtggcacagtctcagctcactgcaacctctgcctcccagttcaagcaattcttctgcctcagcctcccaagtagctgggattacaggcacccgccaccacgcccagctaatttttgtatttttgtagagatggggtttcacgatgttggccaggctggtctcaaacttctgacctcaagtgatctgcccaccttggcctcccaaagtgctgggattacaggtgtaagccactgcgcccggcctttttaactttaaacatgttttagaattcacctaaagatcaaaatatcatggattgaacctcatcaattgatagcagtgagtgactgaagcttccaaatcaagaaaagccggcaccaagaacttccattctaatctagagctgaccagtttgagctgattctctctttgaagagtccttcttgattgcagtgcagtactggcatttctgaatggatgtaagtggagtattttagtctaaaggcttttcaaattacttgaatttttttaaaaattgaggagctttatttctatttacccttccatttttgtatatcaaatttccattgtcattaaaaactgtatcttgaaactttgtgaactgacttgctgtatttgcactttgagctcttgaaataaatgtgatttttgtgtgattatctggtttccagttttaaacattaactgtcaccttttattcttaaacttgaaagtacagaaatcattaaattattaagttgtacaataaaaaaaaaaaaaaa

SEQ ID NO: 90 - protein, 293 aa, Homo sapiens
  GenBank Accession No. NP_006736
MATNESVSIFSSASLAVEYVDSLLPENPLQEPFKNAWNYMLNNYTKFQIATWGSLIVHEALYFLFCLPGFLFQFIPYMKKYKIQKDKPETWENQWKCFKVLLFNHFCIQLPLICGTYYFTEYFNIPYDWERMPRWYFLLARCFGCAVIEDTWHYFLHRLLHHKRIYKYIHKVHHEFQAPFGMEAEYAHPLETLILGTGFFIGIVLLCDHVILLWAWVTIRLLETIDVHSGYDIPLNPLNLIPFYAGSRHHDFHHMNFIGNYASTFTWWDRIFGTDSQYNAYNEKRKKFEKKTE

SEQ ID NO: 91 - DNA, 2087 bp, Homo sapiens
  GenBank Accession No. NM_000431
attgaccaatgttcaagcctattggtaaaggtactccgggctcgcgcgctctgattggctggcctgaagtacaacgcctcctccccttgaggcacgggcgctctgggttgtgggagttggggagctgctccggcttcggcgcggaggggcggcggccggggaggcggcggcggcggcaggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctggagcaaggtgatgtcacaacacccacctcagagcaagtggagaagctaaaggaggttgcaggcttgcctgacgactgtgctgtcaccgagcgcctggctgtgctggcctttctttacttatacctgtccatctgccggaagcagagggccctgccgagcctggatatcgtagtgtggtcggagctgccccccggggcgggcttgggctccagcgccgcctactcggtgtgtctggcagcagccctcctgactgtgtgcgaggagatcccaaacccgctgaaggacggggattgcgtcaacaggtggaccaaggaggatttggagctaattaacaagtgggccttccaaggggagagaatgattcacgggaacccctccggagtggacaatgctgtcagcacctggggaggagccctccgataccatcaagggaagatttcatccttaaagaggtcgccagctctccagatcctgctgaccaacaccaaagtccctcgcaataccagggcccttgtggctggcgtcagaaacaggctgctcaagttcccagagatcgtggcccccctcctgacctcaatagatgccatctccctggagtgtgagcgcgtgctgggagagatgggggaagccccagccccggagcagtacctcgtgctggaagagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagaggagcccacgacactgcagccccacccagatgcccctttctggattattctgggggctgcagttcgactctgtgctggccagcgagcgcccagctcctgacactgctggagaggccccagccgcttggcgatgccagccaagctctgcagtcccagcggtgggacctagggaggcatggtctgccctctgcatcctctggagccagccgagcaggaggcctaggagggtcctctgagactccagacctgaggcgagaagggctgcttccctgaagctcccacagtcccatctgcttcaggcccccgccttggcctgtgttcttcctggccgcctgggtccaatgctcaggtgctggggcctggttcccggagaagtgtgccttctctctcccttttcagggaccgccccctgtctctcagggccaggcctctccctcctccaggaagccttcccctaccccttgtcgcccctccctcccagagcacctgctgtctgggtggctcactcagcacttggtgtggccttcccttctacctagcgggatggggctcccccaggggctgtcccggaggcggtgggcctggttaaataaggcagggtttatatgcactttcttccgatctgtacctgagaggtttgtggaaaagatggcaaatggggaataaaaagattttgtgtcaacagtaaaaaaaaaaaaaaa

SEQ ID NO: 92 - protein, 396 aa, Homo sapiens
  GenBank Accession No. NP_000422
MLSEVLLVSAPGKVILHGEHAVVHGKVALAVSLNLRTFLRLQPHSNGKVDLSLPNIGIKRAWDVARLQSLDTSFLEQGDVTTPTSEQVEKLKEVAGLPDDCAVTERLAVLAFLYLYLSICRKQRALPSLDIVVWSELPPGAGLGSSAAYSVCLAAALLTVCEEIPNPLKDGDCVNRWTKEDLELINKWAFQGERMIHGNPSGVDNAVSTWGGALRYHQGKISSLKRSPALQILLTNTKVPRNTRALVAGVRNRLLKFPEIVAPLLTSIDAISLECERVLGEMGEAPAPEQYLVLEELIDMNQHHLNALGVGHASLDQLCQVTRARGLHSKLTGAGGGGCGITLLKPGLEQPEVEATKQALTSCGFDCLETSIGAPGVSIHSATSLDSRVQQALDGL

SEQ ID NO: 93 - DNA, 4589 bp, Homo sapiens
  GenBank Accession No. NM_000859
ctcttattggtcgaaggctcgtccagctccgagcgtgcgtaaggtgagggctccttccgctccgcgactgcgttaactggagccaggctgagcgtcggcgccggggttcggtggcctctagtgagatctggaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcattcacttcttagacaaagaattgacaggcttgaatgaagctttgccctttttcctacttttgattgacctttccagagcaagcacattagcaaagtttgccctcagttccaactcacaggatgaagtaagggaaaatattgctcgtggaatggcaattttaggtcctacgtttaccctcgatgctcttgttgaatgtcttgtgattggagttggtaccatgtcaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttggtgatgggagcttgttgtgagaatgttattggatatatgcccatccctgttggagtggcaggacccctttgcttagatgaaaaagaatttcaggttccaatggcaacaacagaaggttgtcttgtggccagcaccaatagaggctgcagagcaataggtcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaagggtacagagaaagcactttcaaaacttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcactcctgccagttgaaaatggatttttaaattatactgtagctgatgaaactcctgattttgtagttaatttattaagtctgggatgtagaacttcaagaagtaagagctaagttctaagttcatgtttgtaaattaatacttcatttggtgctggtctattttgattttggggggtaatcagcattattcttcagaaggggacctgttttcttcaagggaagaaacactcttattcccaaactacagaataatgtgttaaacatgctaaatagttctatcaggaaaacaaatcactgtatttatctccgcaggctatttgttcagagaggccttttgtttaaatataaatgtttaaatataaatgtttgtctggattggctataacatgtctttcagcattaggcttttaagaaacacagggttttgtattctttactaaagatatcagagctcttaatgttgcttagatgagggtgactgtcaagtacaagcaagactgggaccttagaaatcattgtagaaacacagttttgaaagaaaaataccatgtctctaagccaactttaattgcttaaaagacatttttatttagttgaaaaatctagttttttttgtaaactgtatcaaatctgtatatgttgtaataaaacttatgctagtttattggaagtgttcaagaaataaaaatcaacttgtgtactgataaaatactctagcctgggccagagaagataatgttctttaatgttgtccaggaaaccctggcttgcttgccgagcctaatgaaagggaaagtcagctttcagagccagtgaaggagccacgtgaatggccctagaactgtgcctagttcctgtggccaggaggttggtgactgaaacattcacacagggctctttgatggacccacgaacgctcttagctttctcagggggtcagcagagttattgaatcttaattttttttaatgtacaagttttgtataaataataaagaactccttattttgtattacatctaatgcttcaagtgttgctcttggaaagctgatgatgtctcttgtagaagatggactctgaaaaacattccaggaaaccatggcagcatggagagcctcttagtgattgtgtctgcattgttattgtggaagatttaccttttctgttgtacgtaaagcttaaattgcttttgttgtgactttttagccagtgactttttctgagcttttcatggaagtggcagtgaaaaatatgttgagtgttcattttagtgactgtaattaatatcttgctggattaatgttttgtacaattactaaattgtatacattttgttatagaatacttttttctagtttcagtaaataatgaaaaggaagttaataccaaaaaaaaa

SEQ ID NO: 94 - protein, 888 aa, Homo sapiens [sequence omitted]

SEQ ID NO: 95 - DNA, 4258 bp, Homo sapiens
  GenBank Accession No. NM_002340
aggggcggggctgggcggcaggtcccgggtgcggacatctggcagctggcagtgggcggcgtagagcactgcagcagcaatgacggagggcacgtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccgcacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatttgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatggaacatcccaagtctgtgcagcagggagccccatgcccctgggacatgaacccacctgcgtggaatgctgtttgtgaggtgtctacagggtttatagtagtcttgtggacacagaaatgcacaggggacacttacggacacagaaatgcacaggggaggccgagcataaccaggggtgaggggcaggcagcagttgtagttactgccgcggggcactgctatgtgcagggacagccagcacccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctccttatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcacccctctgccttggtgtgcagtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttatcagaag

SEQ ID NO: 96 - protein, 732 aa, Homo sapiens
  GenBank Accession No. NP_002331
MTEGTCLRRRGGPYKTEPATDLGRWRLNCERGRQTWTYLQDERAGREQTGLEAYALGLDTKNYFKDLPKAHTAFEGALNGMTFYVGLQAEDGHWTGDYGGPLFLLPGLLITCHVARIPLPAGYREEIVRYLRSVQLPDGGWGLHIEDKSTVFGTALNYVSLRILGVGPDDPDLVRARNILHKKGGAVAIPSWGKFWLAVLNVYSWEGLNTLFPEMWLFPDWAPAHPSTLWCHCRQVYLPMSYCYAVRLSAAEDPLVQSLRQELYVEDFASIDWLAQRNNVAPDELYTPHSWLLRVVYALLNLYEHHHSAHLRQRAVQKLYEHIVADDRFTKSISIGPISKTINMLVRWYVDGPASTAFQEHVSRIPDYLWMGLDGMKMQGTNGSQIWDTAFAIQALLEAGGHHRPEFSSCLQKAHEFLRLSQVPDNPPDYQKYYRQMRKGGFSFSTLDCGWIVSDCTAEALKAVLLLQEKCPHVTEHIPRERLCDAVAVLLNMRNPDGGFATYETKRGGHLLELLNPSEVFGDIMIDYTYVECTSAVMQALKYFHKRFPEHRAAEIRETLTQGLEFCRRQQRADGSWEGSWGVCFTYGTWFGLEAFACMGQTYRDGTACAEVSRACDFLLSRQMADGGWGEDFESCEERRYLQSAQSQIHNTCWAMMGLMAVRHPDIEAQERGVRCLLEKQLPNGDWPQENIAGVFNKSCAISYTSYRNIFPIWALGRFSQLYPERALAGHP

SEQ ID NO: 97 - DNA, 3451 bp, Homo sapiens
  GenBank Accession No. NM_002130
gtcccgcctcccagcgactctcggcggtgccggagtcgggtgggttggcggctataaagctggtggcgaaggggaggcgccgcggactgtcctttcgtggctcactccctttcctctgctgccgctcggtcacgcttgctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggacggtatgccctggtagttgcaggagatattgctgtatatgccacaggaaatgctagacctacaggtggagttggagcagtagctctgctaattgggccaaatgctcctttaatttttgaacgagggcttcgtgggacacatatgcaacatgcctatgatttttacaagcctgatatgctatctgaatatcctatagtagatggaaaactctccatacagtgctacctcagtgcattagaccgctgctattctgtctactgcaaaaagatccatgcccagtggcagaaagagggaaatgataaagattttaccttgaatgattttggcttcatgatctttcactcaccatattgtaaactggttcagaaatctctagctcggatgttgctgaatgacttccttaatgaccagaatagagataaaaatagtatctatagtggcctggaagcctttggggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtactcacctcagcaattagcagggaagagaattggagtgttttcttatggttctggtttggctgccactctgtactctcttaaagtcacacaagatgctacaccggggtctgctcttgataaaataacagcaagtttatgtgatcttaaatcaaggcttgattcaagaactggtgtggcaccagatgtcttcgctgaaaacatgaagctcagagaggacacccatcatttggtcaactatattccccagggttcaatagattcactctttgaaggaacgtggtacttagttagggtggatgaaaagcacagaagaacttacgctcggcgtcccactccaaatgatgacactttggatgaaggagtaggacttgtgcattcaaacatagcaactgagcatattccaagccctgccaagaaagtaccaagactccctgccacagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcaaaacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttccttttttttttttttttggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttgaaataaagttttagagaaatgtttcagata

SEQ ID NO: 98 - protein, 520 aa, Homo sapiens
  GenBank Accession No. NP_002121
MPGSLPLNAEACWPKDVGIVALEIYFPSQYVDQAELEKYDGVDAGKYTIGLGQAKMGFCTDREDINSLCMTVVQNLMERNNLSYDCIGRLEVGTETIIDKSKSVKTNLMQLFEESGNTDIEGIDTTNACYGGTAAVFNAVNWIESSSWDGRYALVVAGDIAVYATGNARPTGGVGAVALLIGPNAPLIFERGLRGTHMQHAYDFYKPDMLSEYPIVDGKLSIQCYLSALDRCYSVYCKKIHAQWQKEGNDKDFTLNDFGFMIFHSPYCKLVQKSLARMLLNDFLNDQNRDKNSIYSGLEAFGDVKLEDTYFDRDVEKAFMKASSELFSQKTKASLLVSNQNGNMYTSSVYGSLASVLAQYSPQQLAGKRIGVFSYGSGLAATLYSLKVTQDATPGSALDKITASLCDLKSRLDSRTGVAPDVFAENMKLREDTHHLVNYIPQGSIDSLFEGTWYLVRVDEKHRRTYARRPTPNDDTLDEGVGLVHSNIATEHIPSPAKKVPRLPATAAEPEAAVISNGEH

SEQ ID NO: 99 - DNA, 1812 bp, Homo sapiens
  GenBank Accession No. NM_002461
tgggaccatggcctcggagaagccgctggcggcagtcacttgtacagcgccggtcaacatcgcggtcatcaagtactggggcaagcgcgatgaagagctggttctgcccatcaactcctccctgagcgtcactctgcaccaggaccagttaaaaaccaccacaacagccgtcatcagcaaggacttcaccgaggaccggatttggctgaatggccgggaggaggatgtggggcagccgaggctgcaggcctgcctgcgggagatccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctagcctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagcgctgagaagaagctgacaggcagtaccgtgggcatgcgggccagtgtggagaccagccccctgcttcggttccgggccgagtccgtggtgcccgcgcgcatggcggagatggcccgctgcatccgggagcgagacttccccagcttcgcccagctgaccatgaaggacagcaaccagttccacgccacctgcctcgacaccttcccgcccatctcttacctcaatgccatctcctggcgcatcatccacctggtgcaccgcttcaacgcccaccacggggacaccaaggtggcgtacacctttgacgcgggccccaatgccgtgatcttcaccctggacgacactgtggctgagtttgtggctgctgtgtggcacggctttcccccaggctcgaatggagacacgtttctgaaggggctgcaggtgaggccggcccctctctcagctgagcttcaggctgcgctggccatggagccgacccccggtggggtcaaatacatcattgtcactcaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcactgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattgctgccaaaaaaaaaaaaaaaaa

SEQ ID NO: 100 - protein, 400 aa, Homo sapiens
  GenBank Accession No. NP_002452
MASEKPLAAVTCTAPVNIAVIKYWGKRDEELVLPINSSLSVTLHQDQLKTTTTAVISKDFTEDRIWLNGREEDVGQPRLQACLREIRCLARKRRNSRDGDPLPSSLSCKVHVASVNNFPTAAGLASSAAGYACLAYTLARVYGVESDLSEVARRGSGSACRSLYGGFVEWQMGEQADGKDSIARQVAPESHWPELRVLILVVSAEKKLTGSTVGMRASVETSPLLRFRAESVVPARMAEMARCIRERDFPSFAQLTMKDSNQFHATCLDTFPPISYLNAISWRIIHLVHRFNAHHGDTKVAYTFDAGPNAVIFTLDDTVAEFVAAVWHGFPPGSNGDTFLKGLQVRPAPLSAELQAALAMEPTPGGVKYIIVTQVGPGPQILDDPCAHLLGPDGLPKPAA

SEQ ID NO: 101 - DNA, 2665 bp, Homo sapiens
  GenBank Accession No. NM_001360
aatcgctgacatcatccgggggcgggcgcccctgccctgcgggtgactccgacccctggctagagggtaggcggcgtggagcagcgcgcgcaagcgaggccaggggaaggtgggcgcaggtgaggggccgaggtgtgcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgactggccctgtggtggacatcgtcaccggacatgctcggctctcggacatctgggccaagactccacctataacgaggaaagccgcccagctctataccttgtgggtcaccttccaggtgcttctgtacacgtctctccctgacttctgccataagtttctacccggctacgtaggaggcatccaggagggggccgtgactcctgcaggggttgtgaacaagtatcagatcaatggcctgcaagcctggctcctcacgcacctgctctggtttgcaaacgctcatctcctgtcctggttctcgcccaccatcatcttcgacaactggatcccactgctgtggtgcgccaacatccttggctatgccgtctccaccttcgccatggtcaagggctacttcttccccaccagcgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgatgggcagaggcaccacagcaagctgctggtgtcgggcttctggggcgtggcccgccacttcaactacgtcggcgacctgatgggcagcctggcctactgcctggcctgtggcggcggccacctgctgccctacttctacatcatctacatggccatcctgctgacccaccgctgcctccgggacgagcaccgctgcgccagcaagtacggccgggactgggagcgctacaccgccgcagtgccttaccgcctgctgcctggaatcttctaagggcacgccctagggagaagccctgtggggctgtcaagagcgtgttctgccaggtccatgggggctggcatcccagctccaactcgaggagcctcagtttcctcatctgtaaactggagagagcccagcacttggcaggtgtccagtacctaatcacgctctgttccttgcttttgccttcaagggaattccgagtgtccagcactgccgtattgccagcacagacggattttctctaatcagtgtccctggggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtgggagtggggcgtgcgcgttatccatgtattgcctttcagctctagatccccctcccctgcctgctctgcagtcgtgggtggggcccgtgcgccgtttctccttggtagcgtgcacggtgttgaactgggacactggggagaaaggggctttcatgtcgtttccttcctgctcctgctgcacagctgccaggagtgctctgcctggagtctgcagacctcagagaggtcccagcaccggctgtggcctttcaggtgtaggcaggtgggctctgcttcccgattccctgtgagcgcccaccctctcgaaagaattttctgcttgccctatgactgtgcagactctggctcgagcaacccggggaacttcaccctcaggggcctcccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttcaaataa

SEQ ID NO: 102 - protein, 475 aa, Homo sapiens
  GenBank Accession No. NP_001351
MAAKSQPNIPKAKSLDGVTNDRTASQGQWGRAWEVDWFSLASVIFLLLFAPFIVYYFIMACDQYSCALTGPVVDIVTGHARLSDIWAKTPPITRKAAQLYTLWVTFQVLLYTSLPDFCHKFLPGYVGGIQEGAVTPAGVVNKYQINGLQAWLLTHLLWFANAHLLSWFSPTIIFDNWIPLLWCANILGYAVSTFAMVKGYFFPTSARDCKFTGNFFYNYMMGIEFNPRIGKWFDFKLFFNGRPGIVAWTLINLSFAAKQRELHSHVTNAMVLVNVLQAIYVIDFFWNETWYLKTIDICHDHFGWYLGWGDCVWLPYLYTLQGLYLVYHPVQLSTPHAVGVLLLGLVGYYIFRVANHQKDLFRRTDGRCLIWGRKPKVIECSYTSADGQRHHSKLLVSGFWGVARHFNYVGDLMGSLAYCLACGGGHLLPYFYIIYMAILLTHRCLRDEHRCASKYGRDWERYTAAVPYRLLPGIF

SEQ ID NO: 103 - DNA, 1307 bp, Homo sapiens
  GenBank Accession No. NM_006556
caggccaggctgtgagcgaaggttctgggcggggctggactgttctaagtgagttcgggtgggggagcttcacgaggggaggctgctctgtgaaggaaccgcctttctctccgcgtgtctcacccttttctccccatatctgtttggacatgagctgagggcacggtcgcgggcggtcagccctgttcgcagctacggcgaggaggggcgcgattgttccttgttgccgctccgcttagtggccgcgtccattccgcgcggtgtcccgattttaggggtagggagaagtgtcagcttcaggcatcgcgaggcgtggcggccccatggccccgctgggaggcgccccgcggctggtactgctgttcagcggcaagaggaaatccgggaaggacttcgtgaccgaggcgctgcagagcagacttggagctgatgtctgtgctgtcctccggctctctggtccactcaaggaacagtatgctcaggagcatggcttgaacttccagagactcctggacaccagcacctacaaggaggcctttcggaaggacatgatccgctggggagaggagaaacgccaggctgacccaggcttcttttgcaggaagattgtggagggcatctcccagcccatctggctggtgagtgacacacggagagtgtctgacatccagtggtttcgggaggcctatggggccgtgacgcagacggtccgcgttgtagcgttggagcagagccgacagcagcggggctgggtgttcacgccaggggtggacgatgctgagtcagaatgtggcctggacaacttcggggactttgactgggtcatcgagaaccatggagttgaacagcgcctggaggagcagttggagaacctgatagaatttatccgctccagactttagtcactaggttctaggagtgagctggggcctgctgaggtgggggtggggctgactctgcaaaatgggggtgtcccccgatcctggccgaggtgaggaacagacagggggggtctagattctgagggggttggtggatattgggcaaggcaggaaacctctggagacctcattttctccatggggaagacagccatgctcttcaggaggagactccaagggcaaaggagggtgtcttggctgtgcttgaaggcgaaaccctgccatatccccagtgccagtcccctcagcctgtggtggccttgcatcctgactggatgttctcagccccttgttctgggcaagaacccagagctccccagtgtggatactaataaacctcttggagcacactctcagaaaaaaaaa

SEQ ID NO: 104 - protein, 192 aa, Homo sapiens
  GenBank Accession No. NP_006547
MAPLGGAPRLVLLFSGKRKSGKDFVTEALQSRLGADVCAVLRLSGPLKEQYAQEHGLNFQRLLDTSTYKEAFRKDMIRWGEEKRQADPGFFCRKIVEGISQPIWLVSDTRRVSDIQWFREAYGAVTQTVRVVALEQSRQQRGWVFTPGVDDAESECGLDNFGDFDWVIENHGVEQRLEEQLENLIEFIRSRL

SEQ ID NO: 105 - DNA, 3208 bp, Homo sapiens
  GenBank Accession No. NM_000786
gtgacgcacggggtggcgcgcgtgggacccgaggggtggggctgggtttagtaggagacctggggcaaggccccctgtggacgaccatctgccagcttctctcgttccgtcgattgggaggagcggtggcgacctcggccttcagtgtttccgacggagtgaatggcggcggcggctgggatgctgctgctgggcttgctgcaggcgggtgggtcggtgctgggccaggcgatggagaaggtgacaggcggcaacctcttgtccatgctgctgatcgcctgcgccttcaccctcagcctggtctacctgatccgtctggccgccggccacctggtccagctgcccgcaggggtgaaaagtcctccatacattttctccccaattccattccttgggcatgccatagcatttgggaaaagtccaattgaatttctagaaaatgcatatgagaagtatggacctgtatttagttttaccatggtaggcaagacatttacttaccttctggggagtgatgctgctgcactgctttttaatagtaaaaatgaagacctgaatgcagaagatgtctacagtcgcctgacaacacctgtgtttgggaagggagttgcatacgatgtgcctaatccagttttcttggagcagaagaaaatgttaaaaagtggccttaacatagcccactttaaacagcatgtttctataattgaaaaagaaacaaaggaatactttgagagttggggagaaagtggagaaaaaaatgtgtttgaagctctttctgagctcataattttaacagctagccattgtttgcatggaaaggaaatcagaagtcaactcaatgaaaaggtagcacagctgtatgcagatttggatggaggtttcagccatgcagcctggctcttaccaggttggctgcctttgcctagtttcagacgcagggacagagctcatcgggaaatcaaggatattttctataaggcaatccagaaacgcagacagtctcaagaaaaaattgatgacattctccaaactttactagatgctacatacaaggatgggcgtcctttgactgatgatgaagtagcagggatgcttattggattactcttggcagggcagcatacatcctcaactactagtgcttggatgggcttctttttggccagagacaaaacacttcaaaaaaaatgttatttagaacagaaaacagtctgtggagagaatctgcctcctttaacttatgaccagctcaaggatctaaatttacttgatcgctgtataaaagaaacattaagacttagacctcctataatgatcatgatgagaatggccagaactcctcagactgtggcagggtataccattcctccaggacatcaggtgtgtgtttctcccactgtcaatcaaagacttaaagactcatgggtagaacgcctggactttaatcctgatcgctacttacaggataacccagcatcaggggaaaagtttgcctatgtgccatttggagctgggcgtcatcgttgtattggggaaaattttgcctatgttcaaattaagacaatttggtccactatgcttcgtttatatgaatttgatctcattgatggatactttcccactgtgaattatacaactatgattcacacccctgaaaacccagttatccgttacaaacgaagatcaaaatgaaaaaggttgcaaggaacgaatatatgtgattatcactgtaagccacaaaggcattcgaagagaatgaagtgtacaaaacaactcttgtagtttactgtttttttaagtgtgtaattctaaaagccagtttatgatttaggattttgttaactgaatggttctatcaaatataatagcatttgaaacattttctaatagttatgatacttatacatgtgctttcaggaagttccttggtgaaacaattgttgaggggggatctaggtaattggcagattctaaataatataatttccagatagtaattttaagagtactcatcgctcttgccaaataagttcagggtattcaaatcttggactagtcctgcaaggtataaagaataaaaatcccagtgagatacttggaaaccacagtttattattatttatctgggcaattattgtgtgtgtgaggatggaagggtagggaataatcgaacatctaaagccttgaataagagaatactaattgttttggtatgatgatactcagaaatggagatattataggaaaaagaaatcctttggaattttaactaaaatcactgcatatgggaaattaagagatccaggaccatatttgataagagttcctaaaaataatgtaattattaatgctaaagactgctcatgtatcttgatctaattactaaataattacatatttatttacctgataaatatgtatctagttctacaaggtcacatttatgtggaagtccaaagtcaagtccttaggggataattttgttttggctcagttgttccctgcttcctttttttttttttttttttgagatggagtctcgctctgttgcccaggctggagtgcagtggtgcgatctcagctcactgcatcctctgcctcccgggttcaagcaattctctgcctcagcctcccaagtagttgggattacaggcacctgccaccatgcctggctaattttttgtatttttagtagagacgggggtttcactatgttggctaggctggtcttgaactcctgacctcgtgatccacccgccttggcctcccaaagtgctgggattacaggcatgagccaccgcacctggccttccctgcttcctctctagaatccaattagggatgtttgttactactcatattgattaaaacagttaacaaacttttttctttttaaaatgtgagatcagtgaactctggttttaagataatctgaaacaaggtccttgggagtaataaaattggtcacattctgtaaagcacattctgtttaggaatcaacttatctcaaattgtaactcggggcctaactatatgagatggctgaaaaaataccacatcgtctgttttcactaggtgatgccaaaatattttgctttatgtatattacagttctttttaaaacactggaagactcatgttaaactctaattgtgaaggcagaatctctgctaatttttcagattaaaattctctttgaaaaaataca

SEQ ID NO: 106 - protein, 509 aa, Homo sapiens
  GenBank Accession No. NP_000777
MAAAAGMLLLGLLQAGGSVLGQAMEKVTGGNLLSMLLIACAFTLSLVYLIRLAAGHLVQLPAGVKSPPYIFSPIPFLGHAIAFGKSPIEFLENAYEKYGPVFSFTMVGKTFTYLLGSDAAALLFNSKNEDLNAEDVYSRLTTPVFGKGVAYDVPNPVFLEQKKMLKSGLNIAHFKQHVSIIEKETKEYFESWGESGEKNVFEALSELIILTASHCLHGKEIRSQLNEKVAQLYADLDGGFSHAAWLLPGWLPLPSFRRRDRAHREIKDIFYKAIQKRRQSQEKIDDILQTLLDATYKDGRPLTDDEVAGMLIGLLLAGQHTSSTTSAWMGFFLARDKTLQKKCYLEQKTVCGENLPPLTYDQLKDLNLLDRCIKETLRLRPPIMIMMRMARTPQTVAGYTIPPGHQVCVSPTVNQRLKDSWVERLDFNPDRYLQDNPASGEKFAYVPFGAGRHRCIGENFAYVQIKTIWSTMLRLYEFDLIDGYFPTVNYTTMIHTPENPVIRYKRRSK

SEQ ID NO: 107 - DNA, 2115 bp, Homo sapiens
  GenBank Accession No. NM_004462
ggcggagcggcgggcggggcgtcgccgtactaggcctgccccctgtccggccagcccctcgaagcacctactccacaggtccagccggccggtgagcgcctggggaccgcagaggtgagagtcgcgcccgggagtccgccgcctgcgccaggatggagttcgtgaaatgccttggccaccccgaagagttctacaacctggtgcgcttccggatcgggggcaagcggaaggtgatgcccaagatggaccaggactcgctcagcagcagcctgaaaacttgctacaagtatctcaatcagaccagtcgcagtttcgcagctgttatccaggcgctggatggggaaatgcgcaacgcagtgtgcatattttatctggttctccgagctctggacacactggaagatgacatgaccatcagtgtggaaaagaaggtcccgctgttacacaactttcactctttcctttaccaaccagactggcggttcatggagagcaaggagaaggatcgccaggtgctggaggacttcccaacgatctcccttgagtttagaaatctggctgagaaataccaaacagtgattgccgacatttgccggagaatgggcattgggatggcagagtttttggataagcatgtgacctctgaacaggagtgggacaagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccatttgaatgttcgtaatagtagaaaatgatgtgaattttctttctgttcggctcctatttttctcatcattttgttttctttaattgggttgaatggagtagatagaaatatttatggtttaggtaacagttagatgtttcctaagaatgcaaactgccttttccacacaaaggctgggaataaaattctgggtattctcgtattctcatttaaaggagtttagctttcagagagaaacagcaggattgcttttgaccttttagaagattggtctccagtaaaggtggacatttttgagatttttataataaagaatttaattgctctgcatttgtcaagtaaaaaaaaaa

SEQ ID NO: 108 - protein, 417 aa, Homo sapiens
  GenBank Accession No. NP_004453
MEFVKCLGHPEEFYNLVRFRIGGKRKVMPKMDQDSLSSSLKTCYKYLNQTSRSFAAVIQALDGEMRNAVCIFYLVLRALDTLEDDMTISVEKKVPLLHNFHSFLYQPDWRFMESKEKDRQVLEDFPTISLEFRNLAEKYQTVIADICRRMGIGMAEFLDKHVTSEQEWDKYCHYVAGLVGIGLSRLFSASEFEDPLVGEDTERANSMGLFLQKTNIIRDYLEDQQGGREFWPQEVWSRYVKKLGDFAKPENIDLAVQCLNELITNALHHIPDVITYLSRLRNQSVFNFCAIPQVMAIATLAACYNNQQVFKGAVKIRKGQAVTLMMDATNMPAVKAIIYQYMEEIYHRIPDSDPSSSKTRQIISTIRTQNLPNCQLISRSHYSPIYLSFVMLLAALSWQYLTTLSQVTEDYVQTGEH

SEQ ID NO: 109 - DNA, 1555 bp, Homo sapiens
  GenBank Accession No. NM_002004
tcagcgcggctcatcttcgcccagccaggacacgcaggatcgcgttatctgtccctcccgcgggcacattgggagttgtagtctaattatatatttccgcccttagtgtggggagagcgggaactactcgacccacagagccgatcgcggagcggattctgcttttaggagtacccgccaacaagcgggaccgagcaggaatccgtatctgggaacaggatgcccctgtcccgctggttgagatctgtgggggtcttcctgctgccagccccctactgggcaccccgggagaggtggctgggttccctacggcggccctccctggtgcacgggtacccagtcctggcctggcacagtgcccgctgctggtgccaagcgtggacagaggaacctcgagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaaccttcaaaaaaaaaaaaaaaaaaa

SEQ ID NO: 110 - protein, 419 aa, Homo sapiens
  GenBank Accession No. NP_001995
MPLSRWLRSVGVFLLPAPYWAPRERWLGSLRRPSLVHGYPVLAWHSARCWCQAWTEEPRALCSSLRMNGDQNSDVYAQEKQDFVQHFSQIVRVLTEDEMGHPEIGDAIARLKEVLEYNAIGGKYNRGLTVVVAFRELVEPRKQDADSLQRAWTVGWCVELLQAFFLVADDIMDSSLTRRGQICWYQKPGVGLDAINDANLLEACIYRLLKLYCREQPYYLNLIELFLQSSYQTEIGQTLDLLTAPQGNVDLVRFTEKRYKSIVKYKTAFYSFYLPIAAAMYMAGIDGEKEHANAKKILLEMGEFFQIQDDYLDLFGDPSVTGKIGTDIQDNKCSWLVVQCLQRATPEQYQILKENYGQKEAEKVARVKALYEELDLPAVFLQYEEDSYSHIMALIEQYAAPLPPAVFLGLARKIYKRRK

SEQ ID NO: 111 - DNA, 2989 bp, Homo sapiens
  GenBank Accession No. NM_003129
gtctgggccgagcccgcccagctggctgagacgcgtggagcctggcggcgagtgggggcgtgcgacggttactctggttactggggccgcgccgcgctggcgagagccgccgcccgcgagggatgctggtgaggaagccgtcgggagccgccgccgccatctgagggaggtaccctggaaaccaccttttatcggtggggaagtgcagtcgcggtgggcggctctgggggccagcgaaacgggaggcctctaaatctttaggttggggctgcattgccctggagccgcactcttgagtccgaggccatcttttgttggagaaggcgtcggcgttggcgttttcccgaggttgggctgtacagtgtctccgtccgcggaaaaagaagcctctgaacccgcgccggcccgcagcccccgtgccttccggccgctgctcgccgtcgccagaggctaggccacgtttcccccagtgccgaggtgtttctgtgaccctccctccactcccattcccttctgaaagggcacctgctcttggtgagaaaagaaattatagcacgaagagccagtatcagaagagtatccatcacccgcagcaaccgctcagggaacaccatcaaaaaagaaaaaaagggaatatctggatttcctgggcgaggaggagcgagtctgctcgggagctgttccagcaggcgatttttaaatactgctttctacgccctatacaacttggcttcacatacttttacactaactttatatgatttttaaaaactggtctgatcggacttctcgtcctgggacactgtttactggagtctggccggctctccgtgctcctcttggtacctcattttggggagaaccttaaacccactcgagcagataatctccgccttgaccggtgccaccaaagaagccttggaaccatgtggacttttctgggcattgccactttcacctatttttataagaagttcggggacttcatcactttggccaacagggaggtcctgttgtgcgtgctggtgttcctctcgctgggcctggtgctctcctaccgctgtcgccaccgaaacgggggtctcctcgggcgccagcagagcggctcccagttcgccctcttctcggatattctctcaggcctgcctttcattggcttcttctgggccaaatccccccctgaatcagaaaataaggagcagctcgaggccaggaggcgcagaaaaggaaccaatatttcagaaacaagcttaataggaacagctgcctgtacatcaacatcttctcagaatgacccagaagttatcatcgtgggagctggcgtgcttggctctgctttggcagctgtgctttccagagatggaagaaaggtgacagtcattgagagagacttaaaagagcctgacagaatagttggagaattcctgcagccgggtggttatcatgttctcaaagaccttggtcttggagatacagtggaaggtcttgatgcccaggttgtaaatggttacatgattcatgatcaggaaagcaaatcagaggttcagattccttaccctctgtcagaaaacaatcaagtgcagagtggaagagctttccatcacggaagattcatcatgagtctccggaaagcagctatggcagagcccaatgcaaagtttattgaaggtgttgtgttacagttattagaggaagatgatgttgtgatgggagttcagtacaaggataaagagactggagatatcaaggaactccatgctccactgactgttgttgcagatgggcttttctccaagttcaggaaaagcctggtctccaataaagtttctgtatcatctcattttgttggctttcttatgaagaatgcaccacagtttaaagcaaatcatgctgaacttattttagctaacccgagtccagttctcatctaccagatttcatccagtgaaactcgagtacttgttgacattagaggagaaatgccaaggaatttaagagaatacatggttgaaaaaatttacccacaaatacctgatcacctgaaagaaccattcttagaagccactgacaattctcatctgaggtccatgccagcaagcttccttcctccttcatcagtgaagaaacgaggtgttcttcttttgggagacgcatataatatgaggcatccacttactggtggaggaatgactgttgcttttaaagatataaaactatggagaaaactgctaaagggtatccctgacctttatgatgatgcagctattttcgaggccaaaaaatcattttactgggcaagaaaaacatctcattcctttgtcgtgaatatccttgctcaggctctttatgaattattttctgccacagatgattccctgcatcaactaagaaaagcctgttttctttatttcaaacttggtggcgaatgtgttgcgggtcctgttgggctgctttctgtattgtctcctaaccctctagttttaattggacacttctttgctgttgcaatctatgccgtgtatttttgctttaagtcagaaccttggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagatttggattaatttgtttttgaagttttttgtatataaatatgtaaatacatgctttaatttgcaatttaaaatgaaggggttaaataagttagacatttaaaagaaatgattgttaccataaattagtgctaatgctgaggagaactacagtttttcttttgaatttagtatttgagatgagttgttgggacatgcaaataaaatgaagaatgaa

SEQ ID NO: 112 - protein, 574 aa, Homo sapiens
  GenBank Accession No. NP_003120
MWTFLGIATFTYFYKKFGDFITLANREVLLCVLVFLSLGLVLSYRCRHRNGGLLGRQQSGSQFALFSDILSGLPFIGFFWAKSPPESENKEQLEARRRRKGTNISETSLIGTAACTSTSSQNDPEVIIVGAGVLGSALAAVLSRDGRKVTVIERDLKEPDRIVGEFLQPGGYHVLKDLGLGDTVEGLDAQVVNGYMIHDQESKSEVQIPYPLSENNQVQSGRAFHHGRFIMSLRKAAMAEPNAKFIEGVVLQLLEEDDVVMGVQYKDKETGDIKELHAPLTVVADGLFSKFRKSLVSNKVSVSSHFVGFLMKNAPQFKANHAELILANPSPVLIYQISSSETRVLVDIRGEMPRNLREYMVEKIYPQIPDHLKEPFLEATDNSHLRSMPASFLPPSSVKKRGVLLLGDAYNMRHPLTGGGMTVAFKDIKLWRKLLKGIPDLYDDAAIFEAKKSFYWARKTSHSFVVNILAQALYELFSATDDSLHQLRKACFLYFKLGGECVAGPVGLLSVLSPNPLVLIGHFFAVAIYAVYFCFKSEPWITKPRALLSSGAVLYKACSVIFPLIYSEMKYMVH

SEQ ID NO: 113 - DNA, 2150 bp, Homo sapiens
  GenBank Accession No. NM_004508
ctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcagtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggattattgcatcgagcttttagtgtcttcttattcaacaccgaaaataagcttctgctacagcaaagatcagatgctaagattacctttccaggttgttttacgaatacgtgttgtagtcatccattaagcaatccagccgagcttgaggaaagtgacgcccttggagtgaggcgagcagcacagagacggctgaaagctgagctaggaattcccttggaagaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagttaaaaaaaaaaaaaaaa

SEQ ID NO: 114 - protein, 284 aa, Homo sapiens
  GenBank Accession No. NP_004499
MWRGLALARAIGCAARGRGQWAVRAADCAQSGRHPGPAVVCGRRLISVLEQIRHFVMMPEINTNHLDKQQVQLLAEMCILIDENDNKIGAETKKNCHLNENIEKGLLHRAFSVFLFNTENKLLLQQRSDAKITFPGCFTNTCCSHPLSNPAELEESDALGVRRAAQRRLKAELGIPLEEVPPEEINYLTRIHYKAQSDGIWGEHEIDYILLVRKNVTLNPDPNEIKSYCYVSKEELKELLKKAASGEIKITPWFKIIAATFLFKWWDNLNHLNQFVDHEKIYRM

SEQ ID NO: 115 - DNA, 3687 bp, Homo sapiens
  GenBank Accession No. NM_006516.2
tccaccattttgctagagaaggccgcggaggctcagagaggtgcgcacacttgccctgagtcacacagcgaatgccctccgcggtcccaacgcagagagaacgagccgatcggcagcctgagcgaggcagtggttagggggggccccggccccggccactcccctcaccccctccccgcagagcgccgcccaggacaggctgggccccaggccccgccccgaggtcctgcccacacacccctgacacaccggcgtcgccagccaatggccggggtcctataaacgctacggtccgcgcgctctctggcaagaggcaagaggtagcaacagcgagcgtgccggtcgctagtcgcgggtccccgagtgagcacgccagggagcaggagaccaaacgacgggggtcggagtcagagtcgcagtgggagtccccggaccggagcacgagcctgagcgggagagcgccgctcgcacgcccgtcgccacccgcgtacccggcgcagccagagccaccagcgcagcgctgccatggagcccagcagcaagaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtgagtcgccccagatcaccagcccggcctgctcccagcagccctaaggatctctcaggagcacaggcagctggatgagacttccaaacctgacagatgtcagccgagccgggcctggggctcctttctccagccagcaatgatgtccagaagaatattcaggacttaacggctccaggattttaacaaaagcaagactgttgctcaaatctattcagacaagcaacaggttttataatttttttattactgattttgttatttttatatcagcctgagtctcctgtgcccacatcccaggcttcaccctgaatggttccatgcctgagggtggagactaagccctgtcgagacacttgccttcttcacccagctaatctgtagggctggacctatgtcctaaggacacactaatcgaactatgaactacaaagcttctatcccaggaggtggctatggccacccgttctgctggcctggatctccccactctaggggtcaggctccattaggatttgccccttcccatctcttcctacccaaccactcaaattaatctttctttacctgagaccagttgggagcactggagtgcagggaggagaggggaagggccagtctgggctgccgggttctagtctcctttgcactgagggccacactattaccatgagaagagggcctgtgggagcctgcaaactcactgctcaagaagacatggagactcctgccctgttgtgtatagatgcaagatatttatatatatttttggttgtcaatattaaatacagacactaagttatagtatatctggacaagccaacttgtaaatacaccacctcactcctgttacttacctaaacagatataaatggctggtttttagaaacatggttttgaaatgcttgtggattgagggtaggaggtttggatgggagtgagacagaagtaagtggggttgcaaccactgcaacggcttagacttcgactcaggatccagtcccttacacgtacctctcatcagtgtcctcttgctcaaaaatctgtttgatccctgttacccagagaatatatacattctttatcttgacattcaaggcatttctatcacatatttgatagttggtgttcaaaaaaacactagttttgtgccagccgtgatgctcaggcttgaaatgcattattttgaatgtgaagtaaatactgtacctttattggacaggctcaaagaggttatgtgcctgaagtcgcacagtgaataagctaaaacacctgcttttaacaatggtaccatacaaccactactccattaactccacccacctcctgcacccctccccacacacacaaaatgaaccacgttctttgtatgggcccaatgagctgtcaagctgccctgtgttcatttcatttggaattgccccctctggttcctctgtatactactgcttcatctctaaagacagctcatcctcctccttcacccctgaatttccagagcacttcatctgctccttcatcacaagtccagttttctgccactagtctgaatttcatgagaagatgccgatttggttcctgtgggtcctcagcactattcagtacagtgcttgatgcacagcaggcactcagaaaatactggaggaaataaaacaccaaagatatttgtcaaaaaaaaaaaaaaaaa

SEQ ID NO: 116 - protein, 492 aa, Homo sapiens
  GenBank Accession No. NP_006507.2
MEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTALRGALGTLHQLGIVVGILIAQVFGLDSIMGNKDLWPLLLSIIFIPALLQCIVLPFCPESPRFLLINRNEENRAKSVLKKLRGTADVTHDLQEMKEESRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAILMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 117 - DNA, 3724 bp, Homo sapiens
  GenBank Accession No. NM_006218.2
tctccctcggcgccgccgccgccgcccgcggggctgggacccgatgcggttagagccgcggagcctggaagagccccgagcgtttctgctttgggacaaccatacatctaattccttaaagtagttttatatgtaaaacttgcaaagaatcagaacaatgcctccacgaccatcatcaggtgaactgtggggcatccacttgatgcccccaagaatcctagtagaatgtttactaccaaatggaatgatagtgactttagaatgcctccgtgaggctacattaataaccataaagcatgaactatttaaagaagcaagaaaataccccctccatcaacttcttcaagatgaatcttcttacattttcgtaagtgttactcaagaagcagaaagggaagaattttttgatgaaacaagacgactttgtgaccttcggctttttcaaccctttttaaaagtaattgaaccagtaggcaaccgtgaagaaaagatcctcaatcgagaaattggttttgctatcggcatgccagtgtgtgaatttgatatggttaaagatccagaagtacaggacttccgaagaaatattctgaacgtttgtaaagaagctgtggatcttagggacctcaattcacctcatagtagagcaatgtatgtctatcctccaaatgtagaatcttcaccagaattgccaaagcacatatataataaattagataaagggcaaataatagtggtgatctgggtaatagtttctccaaataatgacaagcagaagtatactctgaaaatcaaccatgactgtgtaccagaacaagtaattgctgaagcaatcaggaaaaaaactcgaagtatgttgctatcctctgaacaactaaaactctgtgttttagaatatcagggcaagtatattttaaaagtgtgtggatgtgatgaatacttcctagaaaaatatcctctgagtcagtataagtatataagaagctgtataatgcttgggaggatgcccaatttgatgttgatggctaaagaaagcctttattctcaactgccaatggactgttttacaatgccatcttattccagacgcatttccacagctacaccatatatgaatggagaaacatctacaaaatccctttgggttataaatagtgcactcagaataaaaattctttgtgcaacctacgtgaatgtaaatattcgagacattgataagatctatgttcgaacaggtatctaccatggaggagaacccttatgtgacaatgtgaacactcaaagagtaccttgttccaatcccaggtggaatgaatggctgaattatgatatatacattcctgatcttcctcgtgctgctcgactttgcctttccatttgctctgttaaaggccgaaagggtgctaaagaggaacactgtccattggcatggggaaatataaacttgtttgattacacagacactctagtatctggaaaaatggctttgaatctttggccagtacctcatggattagaagatttgctgaaccctattggtgttactggatcaaatccaaataaagaaactccatgcttagagttggagtttgactggttcagcagtgtggtaaagttcccagatatgtcagtgattgaagagcatgccaattggtctgtatcccgagaagcaggatttagctattcccacgcaggactgagtaacagactagctagagacaatgaattaagggaaaatgacaaagaacagctcaaagcaatttctacacgagatcctctctctgaaatcactgagcaggagaaagattttctatggagtcacagacactattgtgtaactatccccgaaattctacccaaattgcttctgtctgttaaatggaattctagagatgaagtagcccagatgtattgcttggtaaaagattggcctccaatcaaacctgaacaggctatggaacttctggactgtaattacccagatcctatggttcgaggttttgctgttcggtgcttggaaaaatatttaacagatgacaaactttctcagtatttaattcagctagtacaggtcctaaaatatgaacaatatttggataacttgcttgtgagatttttactgaagaaagcattgactaatcaaaggattgggcactttttcttttggcatttaaaatctgagatgcacaataaaacagttagccagaggtttggcctgcttttggagtcctattgtcgtgcatgtgggatgtatttgaagcacctgaataggcaagtcgaggcaatggaaaagctcattaacttaactgacattctcaaacaggagaagaaggatgaaacacaaaaggtacagatgaagtttttagttgagcaaatgaggcgaccagatttcatggatgctctacagggctttctgtctcctctaaaccctgctcatcaactaggaaacctcaggcttgaagagtgtcgaattatgtcctctgcaaaaaggccactgtggttgaattgggagaacccagacatcatgtcagagttactgtttcagaacaatgagatcatctttaaaaatggggatgatttacggcaagatatgctaacacttcaaattattcgtattatggaaaatatctggcaaaatcaaggtcttgatcttcgaatgttaccttatggttgtctgtcaatcggtgactgtgtgggacttattgaggtggtgcgaaattctcacactattatgcaaattcagtgcaaaggcggcttgaaaggtgcactgcagttcaacagccacacactacatcagtggctcaaagacaagaacaaaggagaaatatatgatgcagccattgacctgtttacacgttcatgtgctggatactgtgtagctaccttcattttgggaattggagatcgtcacaatagtaacatcatggtgaaagacgatggacaactgtttcatatagattttggacactttttggatcacaagaagaaaaaatttggttataaacgagaacgtgtgccatttgttttgacacaggatttcttaatagtgattagtaaaggagcccaagaatgcacaaagacaagagaatttgagaggtttcaggagatgtgttacaaggcttatctagctattcgacagcatgccaatctcttcataaatcttttctcaatgatgcttggctctggaatgccagaactacaatcttttgatgacattgcatacattcgaaagaccctagccttagataaaactgagcaagaggctttggagtatttcatgaaacaaatgaatgatgcacatcatggtggctggacaacaaaaatggattggatcttccacacaattaaacagcatgcattgaactgaaaagataactgagaaaatgaaagctcactctggattccacactgcactgttaataactctcagcaggcaaagaccgattgcataggaattgcacaatccatgaacagcattagaatttacagcaagaacagaaataaaatactatataatttaaataatgtaaacgcaaacagggtttgatagcacttaaactagttcatttcaaaattaagctttagaataatgcgcaatttcatgttatgccttaagtccaaaaaggtaaactttgaagattgtttgtatctttttttaaaaaacaaaacaaaacaaaaatccccaaaatatatagaaatgatggagaaggaaaaaaaaaaaaaaaaa

SEQ ID NO: 118 - protein, 1068 aa, Homo sapiens
  GenBank Accession No. NP_006209
MPPRPSSGELWGIHLMPPRILVECLLPNGMIVTLECLREATLITIKHELFKEARKYPLHQLLQDESSYIFVSVTQEAEREEFFDETRRLCDLRLFQPFLKVIEPVGNREEKILNREIGFAIGMPVCEFDMVKDPEVQDFRRNILNVCKEAVDLRDLNSPHSRAMYVYPPNVESSPELPKHIYNKLDKGQIIVVIWVIVSPNNDKQKYTLKINHDCVPEQVIAEAIRKKTRSMLLSSEQLKLCVLEYQGKYILKVCGCDEYFLEKYPLSQYKYIRSCIMLGRMPNLMLMAKESLYSQLPMDCFTMPSYSRRISTATPYMNGETSTKSLWVINSALRIKILCATYVNVNIRDIDKIYVRTGIYHGGEPLCDNVNTQRVPCSNPRWNEWLNYDIYIPDLPRAARLCLSICSVKGRKGAKEEHCPLAWGNINLFDYTDTLVSGKMALNLWPVPHGLEDLLNPIGVTGSNPNKETPCLELEFDWFSSVVKFPDMSVIEEHANWSVSREAGFSYSHAGLSNRLARDNELRENDKEQLKAISTRDPLSEITEQEKDFLWSHRHYCVTIPEILPKLLLSVKWNSRDEVAQMYCLVKDWPPIKPEQAMELLDCNYPDPMVRGFAVRCLEKYLTDDKLSQYLIQLVQVLKYEQYLDNLLVRFLLKKALTNQRIGHFFFWHLKSEMHNKTVSQRFGLLLESYCRACGMYLKHLNRQVEAMEKLINLTDILKQEKKDETQKVQMKFLVEQMRRPDFMDALQGFLSPLNPAHQLGNLRLEECRIMSSAKRPLWLNWENPDIMSELLFQNNEIIFKNGDDLRQDMLTLQIIRIMENIWQNQGLDLRMLPYGCLSIGDCVGLIEVVRNSHTIMQIQCKGGLKGALQFNSHTLHQWLKDKNKGEIYDAAIDLFTRSCAGYCVATFILGIGDRHNSNIMVKDDGQLFHIDFGHFLDHKKKKFGYKRERVPFVLTQDFLIVISKGAQECTKTREFERFQEMCYKAYLAIRQHANLFINLFSMMLGSGMPELQSFDDIAYIRKTLALDKTEQEALEYFMKQMNDAHHGGWTTKMDWIFHTIKQHALN

SEQ ID NO: 119 - DNA, 3008 bp, Homo sapiens
  GenBank Accession No. NM_005163.2
taattatgggtctgtaaccaccctggactgggtgctcctcactgacggacttgtctgaacctctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaaaaaaaaaaaaaaaaaaaaa

SEQ ID NO: 120 - protein, 480 aa, Homo sapiens [sequence omitted]

SEQ ID NO: 121 - DNA, 2878 bp, Homo sapiens
  GenBank Accession No. NM_001014432.1
cggcaggaccgagcgcggcaggcggctggcccagcgcagccagcgcggcccgaaggacgggagcaggcggccgagcaccgagcgctgggcaccgggcaccgagcggcggcggcacgcgaggcccggccccgagcagcgcccccgcccgccgcggcctccagcccggccccgcccagcgccggcccgcggggatgcggagcggcgggcgccggaggccgcggcccggctaggcccgcgctcgcgcccggacgcggcggcccggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaaaaaaaaaaaaaaaaaaaaa

SEQ ID NO: 122 - protein, 480 aa, Homo sapiens [sequence omitted]

SEQ ID NO: 123 - DNA, 2794 bp, Homo sapiens
  GenBank Accession No. NM_001014431.1
cggcaggaccgagcgcggcaggcggctggcccagcgcagccagcgcggcccgaaggacgggagcaggcggccgagcaccgagcgctgggcaccgggcaccgagcggcggcggcacgcgaggcccggccccgagcagcgcccccgcccgccgcggcctccagcccggccccgcccagcgccggcccgcggggatgcggagcggcgggcgccggaggccgcggcccggctaggcccgcgctcgcgcccggacgcggcggcccgaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaaaaaaaaaaaaaaaaaaaaa

SEQ ID NO: 124 - protein, 480 aa, Homo sapiens [sequence omitted]

SEQ ID NO: 125 - DNA, 5317 bp, Homo sapiens
  GenBank Accession No. NM_001626.4
tgggagggggcggtaagcgggggctggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcatcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaataaattttgagtagaataatcgtcttttgcaatgtacattttaaaaatttcacacattcttttttgtatataaagaacagtgactgggcacagtggctcatgcctgtaatcccagcaatttgggaggccgaggcgggcgggtctcttgaggccaggggttcgagaccagcctgggcatcatagggagaccttcatctctacaaaaaatacaaaaattagctgggcatggtggtgcatgcctgcaatcccagctaacttggaaggctgaggtgaggtgggaagatcacttgagcccaggagtttgaggctgcagtgagctatgattgcggcactgcactgcagcctgggacaatgagactgtgtctctaaaaataaaaaaaaaaaaaacatgatacatgctattaaaaaagacagcaaagcaggagtataagaaaggaaattcacccgaggtcgcagggccttgagtactcattttggtgctgattacctctctgcaaatggacacggcatcataaattggtagtttcctgctctttttgtgtaatcttttccagttaatgtgaagcctctgggggctgccctcgtgcactgatggttgtgtggagtcgggggcggcagtgcgattcccttttagctgctgcatggggggaactcaggctttccagctgcttcctggggttccatggggtagacccctcaaccgcttcagctgccccgttaacaggaattgacttggtttcgtttggtgctaccagcagtcctgtaataaactagctatccatctgtaaaaaaaaaaaaaaaaaa

SEQ ID NO: 126 - protein, 481 aa, Homo sapiens
  GenBank Accession No. NP_001617.1
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSYSASIRE

SEQ ID NO: 127 - DNA, 5280 bp, Homo sapiens
  GenBank Accession No. NM_001243027.1
tgggagggggcggtaagcgggggctggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcatcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaataaattttgagtagaataatcgtcttttgcaatgtacattttaaaaatttcacacattcttttttgtatataaagaacagtgactgggcacagtggctcatgcctgtaatcccagcaatttgggaggccgaggcgggcgggtctcttgaggccaggggttcgagaccagcctgggcatcatagggagaccttcatctctacaaaaaatacaaaaattagctgggcatggtggtgcatgcctgcaatcccagctaacttggaaggctgaggtgaggtgggaagatcacttgagcccaggagtttgaggctgcagtgagctatgattgcggcactgcactgcagcctgggacaatgagactgtgtctctaaaaataaaaaaaaaaaaaacatgatacatgctattaaaaaagacagcaaagcaggagtataagaaaggaaattcacccgaggtcgcagggccttgagtactcattttggtgctgattacctctctgcaaatggacacggcatcataaattggtagtttcctgctctttttgtgtaatcttttccagttaatgtgaagcctctgggggctgccctcgtgcactgatggttgtgtggagtcgggggcggcagtgcgattcccttttagctgctgcatggggggaactcaggctttccagctgcttcctggggttccatggggtagacccctcaaccgcttcagctgccccgttaacaggaattgacttggtttcgtttggtgctaccagcagtcctgtaataaactagctatccatctgtaaaaaaaaaaaaaaaaaa

SEQ ID NO: 128 - protein, 419 aa, Homo sapiens
  GenBank Accession No. NP_001229956.1
MKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSYSASIRE

SEQ ID NO: 129 - DNA, 5187 bp, Homo sapiens
  GenBank Accession No. NM_001243028.1
tgggagggggcggtaagcgggggctggggggagggggcggggggggccgcgccgtgctagccgttgggcctgcctcggaggaggcgtcgccgccgccgctgccgctgccggcgccgttgccgctgccgggaaacacaaggaaagggaaccagcgcagcgtggcgatgggcgggggtagagccccgccggagaggctgggcggctgccggtgacaggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttccccctaactttttacttagcctttttggtttgtgtccccacccccacctcctcaccccctttccagttcttcttcaggcccctcccagacgcaccccagcggcccctgcagcccctgcctccagcctccagcctcacctttgtgcccagactcgcatttggaagactccacctcccgcccaggcctgggctgttgggcggttggagattcaggttttaatccacacaagccccagtgaggggtgaagcatggcgcctggggcctgcctgagtttctggcctgggtgtcgtgctggtgtctgcctccgcgctgctgcatctggacgaaggctgccttctggtgggacgcgacacccggcagacagtggtgctgccttccaggccccgtggcctaggctcggagtggccaggcacggggcggtccaatcccccacccgctgtccccctatgggggcagaaaagcaataatgtccaggggcaggcaggggcccttgggagctgcagggctgggggttagggctgctccctggtgaatggagtcagatcctaggatctgtaccatggggaaccaggagtggccgggctgggtgccgcctcctggtccggcctcctccccaccaaactgtcctcaccctatggatgaggcaggaggaacatttggggccaaacctgcctgcctcccagccccgtgccttactagggcttccttccagctggccttacctcccgctggaccctgggcctggcctggccccactgggggctatgggctgggctcaccctctcctctgcgggggtggagggccaccagccttggctgttacaatcttacaccggacagtattgggccccatggacttggtcagggaggggtgggggtgggcatctctggtacctattggggtggggggcctctgaaaagggaggctcctaggcccccctcacccctccctctccccagggccccacgttctgcagccttaaggttgaacatgagtgcacgtccatgtcagtgctgtgggactcctgtgcgtgcctcggactgcgtgtgtcggcgggacgcaggcacacgtgggtgtgtgtgcatgtgtgtttgtgtgagggcagcgtgtcctccagtgtgcatggtgtgtgggcttgggccccatccctggcccgagcatttcatcctgtgggggaggggtgctgacctagtgggaggagccccactgtgatccatgagctgccctgcccacgcctcccctccctgtagcaacacctctgggtgtttggagtttagcttttgtgggtttgctctccctatcccatctcctgtactacacagttcatggcagggtggggaggggtggggttggttcgggtgggtgagggtctttttcctctgtgtgcgatgttgttatctgacagttctccgtccctactggcctttctcctcgtcttcatatttgtacggtacaagcaataaagacactcatttcagaccagggcccagcctgcactcacgccagcccaaccactctgggctttgccttggtgatggagtcagacccctgggccccagctcctcctgtactagccgttcccttcagcaaggagggcactgagctcagggtgagggcagctggggtgtgtgcaggagctcaggctggagagggtgggtggagctggtgctgtggggctgaggggtatgggaaggctccccgcatgtgggggtggggtggacagagaccactccaggccctcagtgctgcttaggctaagagaggtggggtggagggacagggctggaagatctgggtagcccagaatgaggagggtgcctgtgctgtcactgaatgagagggagtggttcattccacccggctgccgagcctcagaggggggcattcctatcctgccccacctccctgtttatgctgccacctggaagccttgaggcccccaaattccagtacagacccagtggtgtgttcatggtggcgtggttgctgtcacctgggagctcctgagcgtttggttagaaccctgttcagcttggggtcagccctcccctagtcactgccctttagcctggatgtgtctgggcccctgcacttcccgtgcttgagtcacgtggctgcatggccgggcgctggccggatggaacacctcccccagcaagggaccagggaccagagccctggcctgccctgctgagccctgctgtgcagagggcctggcacagatgaatttgagattttgccgcaaggtgttagcacttcacacccattgagtctttgagattttaagtgaatgtaagcagaaaaagtcagatccaatttacagaaatcagagttagctacagctaggactcgtttggttggggttttttagtttgtctttctaaagtcatgtggaccttaatttaattacaaaagtctaccctggtggtcataaaataggcaggcctatgaagaaaggccttttactcttccatctcatcccagccccgagttgacccacgttgctgctcctcacaccatggtgatgcaggtctcgtagtgtgggcacaggcctggctacctcatctttttagtgcctctctcctcttccacaggatggggtcccacagctgcagcagctggccccgtagttgagcatgtgtggttatcctgtagagcttttcccaagaagggtgtttgaacttagagtcttaataaaatcttaccaaataaattttgagtagaataatcgtcttttgcaatgtacattttaaaaatttcacacattcttttttgtatataaagaacagtgactgggcacagtggctcatgcctgtaatcccagcaatttgggaggccgaggcgggcgggtctcttgaggccaggggttcgagaccagcctgggcatcatagggagaccttcatctctacaaaaaatacaaaaattagctgggcatggtggtgcatgcctgcaatcccagctaacttggaaggctgaggtgaggtgggaagatcacttgagcccaggagtttgaggctgcagtgagctatgattgcggcactgcactgcagcctgggacaatgagactgtgtctctaaaaataaaaaaaaaaaaaacatgatacatgctattaaaaaagacagcaaagcaggagtataagaaaggaaattcacccgaggtcgcagggccttgagtactcattttggtgctgattacctctctgcaaatggacacggcatcataaattggtagtttcctgctctttttgtgtaatcttttccagttaatgtgaagcctctgggggctgccctcgtgcactgatggttgtgtggagtcgggggcggcagtgcgattcccttttagctgctgcatggggggaactcaggctttccagctgcttcctggggttccatggggtagacccctcaaccgcttcagctgccccgttaacaggaattgacttggtttcgtttggtgctaccagcagtcctgtaataaactagctatccatctgtaaaaaaaaaaaaaaaaaa

SEQ ID NO: 130 - protein, 419 aa, Homo sapiens; identical to SEQ ID NO: 128
  GenBank Accession No. NP_001229957.1

SEQ ID NO: 131 - DNA, 7091 bp, Homo sapiens
  GenBank Accession No. NM_005465.4
gctgagtcatcactagagagtgggaagggcagcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagaagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggcactgacattgccccaggcgggccactcctcacactggctctcagttcccagccatgcctggggctcagtcacttctattccaccctctgagactccattggtgtcacacaaggtgtcttcttggctttgattttgagaatcccctattttcacttccagatctgtcagctgccatggaggaataatagaaaaccagaaatgcgtgtagagggagatttctaaaacttcccttgtgtcgcccatagttgtagttttgggttctggcaggtggaacaccctgaaacctggaatcattctatgagaatacagttcagactttgcagactccagcccatactaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgctacttctctgtttattgttgttggatgtggttctataatccccccaaattaaatcttctttaatgaaaacatgatttttaatagccccagctggtattaacctaccttgtataaaatgtgacaggaaaatatagaaataattccttgtagctcacacacacacacataggggatcatttttacttcagtgaaatggcagtagtgcggttgtgcaaactttgatgaacggctgcttctgaggggaaacgctgacctctcagcactggatttaggatggatgtactgtgaagccagggatgaaggaggtctcagaccctggggacattcagacccgaatcatctatacaacacacggtttggacccagaatctgaaggaatgtagcttttcattaacgtcttcctgataatgtactgctctgcatatttcctttcttagagtgtatttctaacaacatgtcatggcaaattaacaaacttagacgtgggtgatgtagatgggtaggatggctggactgcagtctgacttcacgttgaatcattctggatggggcctttttctgattttacctcataaagctactattgtagaaacttggctttgctcctgtgacgaagccagacagaggaatggcttttgggaccagagtgagtcaagcatgtatgtgtatgtcacacggccaaatttgagggcattctcacatgtgctcttctctcaaaaccactggggttgacagatccaggaggctaaaaaaaagtgacctctataattctttaaaggtgctatttttagaatattgtataatttattcacagtatatctaaaacagaattaaggacaattaaaatatcttatgtgacagcctttatgtctagcacatttgatgaaataaaaaacttctgaatctgaatagaagttctactgtttcaggcttgaaccttttacatgctcaagagattcaaatggtctctgtgtgtagatcatgccaccgcctccaaagcctaatccacatcacttctgagaggcaaggctgagcatatggtgacatcagctctgtgttgagatggtgatgaggatgatggctcgctggccaggcagggcagccgaaggtcagggacctgtcctaactaactgcagccttgcctttagtgtttgtcattctcagatacaacacggtatgtccagtgtccgtttttattactttaaagcatttgagggcttaattgtgtatagtagaaatactattttagacaaataattatctgtgtacagatatttgatatactctaagtaaattttctaatttcactaagtacgtttttaggctcctctcaaatactgcgtattgaagaaaaaaatctgacaccaccgagccaaagatgcttttttgtctgttttcgttgtttaacagaatggaaagagtaatgcatagtgcttcctggtgtctcctgattgattgattgtgcacaaagtaggacgataaataaataaaatggagtctgatgggacattgattaaaggtgaaggatgattgatatatagatcatgaaaagaaaaatgaatggcaggaaaaaaagtttggtccttaatatactttggcctagttaaaatatgtgcctttttggtgtgttttgttcatcactacaagataaaaaggaaacattacaactcaagtctttaaaaagttcatttattgaaaatcatatgtataacctagcatacgaatgagcagatttaaacacataacttcaagccatttctgaaaacatacaccaggagctctgctcagctagagtcagactccagctccagcccgactgcgtgcggggacagcgcccgcgttgatgaggaccagccccactgcaggctgaggcggtgtcaccctgggaaggtcgtggtgcgttgtggcatattaagtctaaaccagatgaatgtaaatatctctttgtaaatcatttatttcactctgttccatccaggtcagcaatcagattgtggcatgctgggtaactggaaaaaataataaaaagtaagtttcaatagctcaaaaaaaaaa

SEQ ID NO: 132 - protein, 479 aa, Homo sapiens
  GenBank Accession No. NP_005456.1
MSDVTIVKEGWVQKRGEYIKNWRPRYFLLKTDGSFIGYKEKPQDVDLPYPLNNFSVAKCQLMKTERPKPNTFIIRCLQWTTVIERTFHVDTPEEREEWTEAIQAVADRLQRQEEERMNCSPTSQIDNIGEEEMDASTTHHKRKTMNDFDYLKLLGKGTFGKVILVREKASGKYYAMKILKKEVIIAKDEVAHTLTESRVLKNTRHPFLTSLKYSFQTKDRLCFVMEYVNGGELFFHLSRERVFSEDRTRFYGAEIVSALDYLHSGKIVYRDLKLENLMLDKDGHIKITDFGLCKEGITDAATMKTFCGTPEYLAPEVLEDNDYGRAVDWWGLGVVMYEMMCGRLPFYNQDHEKLFELILMEDIKFPRTLSSDAKSLLSGLLIKDPNKRLGGGPDDAKEIMRHSFFSGVNWQDVYDKKLVPPFKPQVTSETDTRYFDEEFTAQTITITPPEKYDEDGMDCMDNERRPHFPQFSYSASGRE

SEQ ID NO: 133 - DNA, 1734 bp, Homo sapiens
  GenBank Accession No. NM_181690.2
gctgagtcatcactagagagtgggaagggcagcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatgtcagcaatcagattgtggcatgctgggtaactggaaaaaataataaaaatcggcttcctacagccagcagcacagtcacccatggaactgttggctttggattaaatgtggaattgaacgactacccagaagtgttctggaaagaagcgagatgtgtggcctgcctcaccgtcctcacccatcaaaagcaccagcaggcacgttaactcgaattctcacaaggaaaaggccattaaagctcaaggtgcatttcaaactccaggctac

SEQ ID NO: 134 - protein, 465 aa, Homo sapiens
  GenBank Accession No. NP_859029.1
MSDVTIVKEGWVQKRGEYIKNWRPRYFLLKTDGSFIGYKEKPQDVDLPYPLNNFSVAKCQLMKTERPKPNTFIIRCLQWTTVIERTFHVDTPEEREEWTEAIQAVADRLQRQEEERMNCSPTSQIDNIGEEEMDASTTHHKRKTMNDFDYLKLLGKGTFGKVILVREKASGKYYAMKILKKEVIIAKDEVAHTLTESRVLKNTRHPFLTSLKYSFQTKDRLCFVMEYVNGGELFFHLSRERVFSEDRTRFYGAEIVSALDYLHSGKIVYRDLKLENLMLDKDGHIKITDFGLCKEGITDAATMKTFCGTPEYLAPEVLEDNDYGRAVDWWGLGVVMYEMMCGRLPFYNQDHEKLFELILMEDIKFPRTLSSDAKSLLSGLLIKDPNKRLGGGPDDAKEIMRHSFFSGVNWQDVYDKKLVPPFKPQVTSETDTRYFDEEFTAQTITITPPEKCQQSDCGMLGNWKK

SEQ ID NO: 135 - DNA, 1584 bp, Homo sapiens
  GenBank Accession No. NM_001206729.1
ctcaaatacacatcaccaaacaaattttctctattatttgggctgagtcatcactagagagtgggaagggcagcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatgtcagcaatcagattgtggcatgctgggtaactggaaaaaataataaaaagtaagtttcaatagctcaaaaaaaaaa

SEQ ID NO: 136 - protein, 465 aa, Homo sapiens; identical to SEQ ID NO: 134
  GenBank Accession No. NP_001193658.1

SEQ ID NO: 137 - DNA, 3291 bp, Homo sapiens
  GenBank Accession No. NM_002880.3
agaatcggagagccggtggcgtcgcaggtcgggaggacgagcaccgagtcgagggctcgctcgtctgggccgcccgagagtcttaatcgcgggcgcttgggccgccatcttagatggcgggagtaagaggaaaacgattgtgaggcgggaacggctttctgctgccttttttgggccccgaaaagggtcagctggccgggctttggggcgcgtgccctgaggcgcggagcgcgtttgctacgatgcgggggctgctcggggctccgtcccctgggctggggacgcgccgaatgtgaccgcctcccgctccctcacccgccgcggggaggaggagcgggcgagaagctgccgccgaacgacaggacgttggggcggcctggctccctcaggtttaagaattgtttaagctgcatcaatggagcacatacagggagcttggaagacgatcagcaatggttttggattcaaagatgccgtgtttgatggctccagctgcatctctcctacaatagttcagcagtttggctatcagcgccgggcatcagatgatggcaaactcacagatccttctaagacaagcaacactatccgtgttttcttgccgaacaagcaaagaacagtggtcaatgtgcgaaatggaatgagcttgcatgactgccttatgaaagcactcaaggtgaggggcctgcaaccagagtgctgtgcagtgttcagacttctccacgaacacaaaggtaaaaaagcacgcttagattggaatactgatgctgcgtctttgattggagaagaacttcaagtagatttcctggatcatgttcccctcacaacacacaactttgctcggaagacgttcctgaagcttgccttctgtgacatctgtcagaaattcctgctcaatggatttcgatgtcagacttgtggctacaaatttcatgagcactgtagcaccaaagtacctactatgtgtgtggactggagtaacatcagacaactcttattgtttccaaattccactattggtgatagtggagtcccagcactaccttctttgactatgcgtcgtatgcgagagtctgtttccaggatgcctgttagttctcagcacagatattctacacctcacgccttcacctttaacacctccagtccctcatctgaaggttccctctcccagaggcagaggtcgacatccacacctaatgtccacatggtcagcaccaccctgcctgtggacagcaggatgattgaggatgcaattcgaagtcacagcgaatcagcctcaccttcagccctgtccagtagccccaacaatctgagcccaacaggctggtcacagccgaaaacccccgtgccagcacaaagagagcgggcaccagtatctgggacccaggagaaaaacaaaattaggcctcgtggacagagagattcaagctattattgggaaatagaagccagtgaagtgatgctgtccactcggattgggtcaggctcttttggaactgtttataagggtaaatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagtttcagatgttccagctaattgacattgcccggcagacggctcagggaatggactatttgcatgcaaagaacatcatccatagagacatgaaatccaacaatatatttctccatgaaggcttaacagtgaaaattggagattttggtttggcaacagtaaagtcacgctggagtggttctcagcaggttgaacaacctactggctctgtcctctggatggccccagaggtgatccgaatgcaggataacaacccattcagtttccagtcggatgtctactcctatggcatcgtattgtatgaactgatgacgggggagcttccttattctcacatcaacaaccgagatcagatcatcttcatggtgggccgaggatatgcctccccagatcttagtaagctatataagaactgccccaaagcaatgaagaggctggtagctgactgtgtgaagaaagtaaaggaagagaggcctctttttccccagatcctgtcttccattgagctgctccaacactctctaccgaagatcaaccggagcgcttccgagccatccttgcatcgggcagcccacactgaggatatcaatgcttgcacgctgaccacgtccccgaggctgcctgtcttctagttgactttgcacctgtcttcaggctgccaggggaggaggagaagccagcaggcaccacttttctgctccctttctccagaggcagaacacatgttttcagagaagctgctgctaaggaccttctagactgctcacagggccttaacttcatgttgccttcttttctatccctttgggccctgggagaaggaagccatttgcagtgctggtgtgtcctgctccctccccacattccccatgctcaaggcccagccttctgtagatgcgcaagtggatgttgatggtagtacaaaaagcaggggcccagccccagctgttggctacatgagtatttagaggaagtaaggtagcaggcagtccagccctgatgtggagacacatgggattttggaaatcagcttctggaggaatgcatgtcacaggcgggactttcttcagagagtggtgcagcgccagacattttgcacataaggcaccaaacagcccaggactgccgagactctggccgcccgaaggagcctgctttggtactatggaacttttcttaggggacacgtcctcctttcacagcttctaaggtgtccagtgcattgggatggttttccaggcaaggcactcggccaatccgcatctcagccctctcagggagcagtcttccatcatgctgaattttgtcttccaggagctgcccctatggggcggggccgcagggccagccttgtttctctaacaaacaaacaaacaaacagccttgtttctctagtcacatcatgtgtatacaaggaagccaggaatacaggttttcttgatgatttgggttttaattttgtttttattgcacctgacaaaatacagttatctgatggtccctcaattatgttattttaataaaataaattaaatttaggtgtaaaaaaaaaaaaaaaaaa

SEQ ID NO: 138 - protein, 648 aa, Homo sapiens [sequence omitted]

SEQ ID NO: 139 - DNA, 2949 bp, Homo sapiens
  GenBank Accession No. NM_004333.4
cgcctcccttccccctccccgcccgacagcggccgctcgggccccggctctcggttataagatggcggcgctgagcggtggcggtggtggcggcgcggagccgggccaggctctgttcaacggggacatggagcccgaggccggcgccggcgccggcgccgcggcctcttcggctgcggaccctgccattccggaggaggtgtggaatatcaaacaaatgattaagttgacacaggaacatatagaggccctattggacaaatttggtggggagcataatccaccatcaatatatctggaggcctatgaagaatacaccagcaagctagatgcactccaacaaagagaacaacagttattggaatctctggggaacggaactgatttttctgtttctagctctgcatcaatggataccgttacatcttcttcctcttctagcctttcagtgctaccttcatctctttcagtttttcaaaatcccacagatgtggcacggagcaaccccaagtcaccacaaaaacctatcgttagagtcttcctgcccaacaaacagaggacagtggtacctgcaaggtgtggagttacagtccgagacagtctaaagaaagcactgatgatgagaggtctaatcccagagtgctgtgctgtttacagaattcaggatggagagaagaaaccaattggttgggacactgatatttcctggcttactggagaagaattgcatgtggaagtgttggagaatgttccacttacaacacacaactttgtacgaaaaacgtttttcaccttagcattttgtgacttttgtcgaaagctgcttttccagggtttccgctgtcaaacatgtggttataaatttcaccagcgttgtagtacagaagttccactgatgtgtgttaattatgaccaacttgatttgctgtttgtctccaagttctttgaacaccacccaataccacaggaagaggcgtccttagcagagactgccctaacatctggatcatccccttccgcacccgcctcggactctattgggccccaaattctcaccagtccgtctccttcaaaatccattccaattccacagcccttccgaccagcagatgaagatcatcgaaatcaatttgggcaacgagaccgatcctcatcagctcccaatgtgcatataaacacaatagaacctgtcaatattgatgacttgattagagaccaaggatttcgtggtgatggaggatcaaccacaggtttgtctgctaccccccctgcctcattacctggctcactaactaacgtgaaagccttacagaaatctccaggacctcagcgagaaaggaagtcatcttcatcctcagaagacaggaatcgaatgaaaacacttggtagacgggactcgagtgatgattgggagattcctgatgggcagattacagtgggacaaagaattggatctggatcatttggaacagtctacaagggaaagtggcatggtgatgtggcagtgaaaatgttgaatgtgacagcacctacacctcagcagttacaagccttcaaaaatgaagtaggagtactcaggaaaacacgacatgtgaatatcctactcttcatgggctattccacaaagccacaactggctattgttacccagtggtgtgagggctccagcttgtatcaccatctccatatcattgagaccaaatttgagatgatcaaacttatagatattgcacgacagactgcacagggcatggattacttacacgccaagtcaatcatccacagagacctcaagagtaataatatatttcttcatgaagacctcacagtaaaaataggtgattttggtctagctacagtgaaatctcgatggagtgggtcccatcagtttgaacagttgtctggatccattttgtggatggcaccagaagtcatcagaatgcaagataaaaatccatacagctttcagtcagatgtatatgcatttggaattgttctgtatgaattgatgactggacagttaccttattcaaacatcaacaacagggaccagataatttttatggtgggacgaggatacctgtctccagatctcagtaaggtacggagtaactgtccaaaagccatgaagagattaatggcagagtgcctcaaaaagaaaagagatgagagaccactctttccccaaattctcgcctctattgagctgctggcccgctcattgccaaaaattcaccgcagtgcatcagaaccctccttgaatcgggctggtttccaaacagaggattttagtctatatgcttgtgcttctccaaaaacacccatccaggcagggggatatggtgcgtttcctgtccactgaaacaaatgagtgagagagttcaggagagtagcaacaaaaggaaaataaatgaacatatgtttgcttatatgttaaattgaataaaatactctctttttttttaaggtgaaccaaagaacacttgtgtggttaaagactagatataatttttccccaaactaaaatttatacttaacattggatttttaacatccaagggttaaaatacatagacattgctaaaaattggcagagcctcttctagaggctttactttctgttccgggtttgtatcattcacttggttattttaagtagtaaacttcagtttctcatgcaacttttgttgccagctatcacatgtccactagggactccagaagaagaccctacctatgcctgtgtttgcaggtgagaagttggcagtcggttagcctgggttagataaggcaaactgaacagatctaatttaggaagtcagtagaatttaataattctattattattcttaataatttttctataactatttctttttataacaatttggaaaatgtggatgtcttttatttccttgaagcaataaactaagtttctttttataaaaa

SEQ ID NO: 140 - protein, 766 aa, Homo sapiens [sequence omitted]

SEQ ID NO: 141 - DNA, 2603 bp, Homo sapiens
  GenBank Accession No. NM_002755.3
aggcgaggcttccccttccccgcccctcccccggcctccagtccctcccagggccgcttcgcagagcggctaggagcacggcggcggcggcactttccccggcaggagctggagctgggctctggtgcgcgcgcggctgtgccgcccgagccggagggactggttggttgagagagagagaggaagggaatcccgggctgccgaaccgcacgttcagcccgctccgctcctgcagggcagcctttcggctctctgcgcgcgaagccgagtcccgggcgggtggggcgggggtccactgagaccgctaccggcccctcggcgctgacgggaccgcgcggggcgcacccgctgaaggcagccccggggcccgcggcccggacttggtcctgcgcagcgggcgcggggcagcgcagcgggaggaagcgagaggtgctgccctccccccggagttggaagcgcgttacccgggtccaaaatgcccaagaagaagccgacgcccatccagctgaacccggcccccgacggctctgcagttaacgggaccagctctgcggagaccaacttggaggccttgcagaagaagctggaggagctagagcttgatgagcagcagcgaaagcgccttgaggcctttcttacccagaagcagaaggtgggagaactgaaggatgacgactttgagaagatcagtgagctgggggctggcaatggcggtgtggtgttcaaggtctcccacaagccttctggcctggtcatggccagaaagctaattcatctggagatcaaacccgcaatccggaaccagatcataagggagctgcaggttctgcatgagtgcaactctccgtacatcgtgggcttctatggtgcgttctacagcgatggcgagatcagtatctgcatggagcacatggatggaggttctctggatcaagtcctgaagaaagctggaagaattcctgaacaaattttaggaaaagttagcattgctgtaataaaaggcctgacatatctgagggagaagcacaagatcatgcacagagatgtcaagccctccaacatcctagtcaactcccgtggggagatcaagctctgtgactttggggtcagcgggcagctcatcgactccatggccaactccttcgtgggcacaaggtcctacatgtcgccagaaagactccaggggactcattactctgtgcagtcagacatctggagcatgggactgtctctggtagagatggcggttgggaggtatcccatccctcctccagatgccaaggagctggagctgatgtttgggtgccaggtggaaggagatgcggctgagaccccacccaggccaaggacccccgggaggccccttagctcatacggaatggacagccgacctcccatggcaatttttgagttgttggattacatagtcaacgagcctcctccaaaactgcccagtggagtgttcagtctggaatttcaagattttgtgaataaatgcttaataaaaaaccccgcagagagagcagatttgaagcaactcatggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgttcagatgtgcatttcacctgtgacaaaggatgaagaacacagcatgtgccaagattctactcttgtcatttttaatattactgtctttattcttattactattattgttcccctaagtggattggctttgtgcttggggctatttgtgtgtatgctgatgatcaaaacctgtgccaggctgaattacagtgaaattttggtgaatgtgggtagtcattcttacaattgcactgctgttcctgctccatgactggctgtctgcctgtattttcgggattctttgacatttggtggtactttattcttgctgggcatactttctctctaggagggagccttgtgagatccttcacaggcagtgcatgtgaagcatgctttgctgctatgaaaatgagcatcagagagtgtacatcatgttattttattattattatttgcttttcatgtagaactcagcagttgacatccaaatctagccagagcccttcactgccatgatagctggggcttcaccagtctgtctactgtggtgatctgtagacttctggttgtatttctatatttattttcagtatactgtgtgggatacttagtggtatgtctctttaagttttgattaatgtttcttaaatggaattattttgaatgtcacaaattgatcaagatattaaaatgtcggatttatctttccccatatccaagtaccaatgctgttgtaaacaacgtgtatagtgcctaaaattgtatgaaaatccttttaaccattttaacctagatgtttaacaaatctaatctcttattctaataaatatactatgaaataaaaaaaaaaggatgaaagctaaaaaaaaaaaaaaaaaa

SEQ ID NO: 142 - protein, 393 aa, Homo sapiens [sequence omitted]

SEQ ID NO: 143 - DNA, 1759 bp, Homo sapiens
  GenBank Accession No. NM_030662.3
cccctgcctctcggactcgggctgcggcgtcagccttcttcgggcctcggcagcggtagcggctcgctcgcctcagccccagcgcccctcggctaccctcggcccaggcccgcagcgccgcccgccctcggccgccccgacgccggcctgggccgcggccgcagccccgggctcgcgtaggcgccgaccgctcccggcccgccccctatgggccccggctagaggcgccgccgccgccggcccgcggagccccgatgctggcccggaggaagccggtgctgccggcgctcaccatcaaccctaccatcgccgagggcccatcccctaccagcgagggcgcctccgaggcaaacctggtggacctgcagaagaagctggaggagctggaacttgacgagcagcagaagaagcggctggaagcctttctcacccagaaagccaaggtcggcgaactcaaagacgatgacttcgaaaggatctcagagctgggcgcgggcaacggcggggtggtcaccaaagtccagcacagaccctcgggcctcatcatggccaggaagctgatccaccttgagatcaagccggccatccggaaccagatcatccgcgagctgcaggtcctgcacgaatgcaactcgccgtacatcgtgggcttctacggggccttctacagtgacggggagatcagcatttgcatggaacacatggacggcggctccctggaccaggtgctgaaagaggccaagaggattcccgaggagatcctggggaaagtcagcatcgcggttctccggggcttggcgtacctccgagagaagcaccagatcatgcaccgagatgtgaagccctccaacatcctcgtgaactctagaggggagatcaagctgtgtgacttcggggtgagcggccagctcatcgactccatggccaactccttcgtgggcacgcgctcctacatggctccggagcggttgcagggcacacattactcggtgcagtcggacatctggagcatgggcctgtccctggtggagctggccgtcggaaggtaccccatccccccgcccgacgccaaagagctggaggccatctttggccggcccgtggtcgacggggaagaaggagagcctcacagcatctcgcctcggccgaggccccccgggcgccccgtcagcggtcacgggatggatagccggcctgccatggccatctttgaactcctggactatattgtgaacgagccacctcctaagctgcccaacggtgtgttcacccccgacttccaggagtttgtcaataaatgcctcatcaagaacccagcggagcgggcggacctgaagatgctcacaaaccacaccttcatcaagcggtccgaggtggaagaagtggattttgccggctggttgtgtaaaaccctgcggctgaaccagcccggcacacccacgcgcaccgccgtgtgacagtggccgggctccctgcgtcccgctggtgacctgcccaccgtccctgtccatgccccgcccttccagctgaggacaggctggcgcctccacccaccctcctgcctcacccctgcggagagcaccgtggcggggcgacagcgcatgcaggaacgggggtctcctctcctgcccgtcctggccggggtgcctctggggacgggcgacgctgctgtgtgtggtctcagaggctctgcttccttaggttacaaaacaaaacagggagagaaaaagcaaaaaaaaaaaaaaaaaaaaaaaaaaaa

SEQ ID NO: 144 - protein, 400 aa, Homo sapiens [sequence omitted]

SEQ ID NO: 145 - DNA, 1902 bp, Homo sapiens
  GenBank Accession No. NM_002746.2
ctggcgcgcgcggccctgcgggtgacaggcaggcgggaaggggcggggcctcgggcggggccgccgtggggaggagggcggtgggaggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctgaaaaaaaaaaaaaaaaaaaaaaaaaaa

SEQ ID NO: 146 - protein, 379 aa, Homo sapiens
  GenBank Accession No. NP_002737.2
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 147 - DNA, 2005 bp, Homo sapiens
  GenBank Accession No. NM_001040056.1
ctggcgcgcgcggccctgcgggtgacaggcaggcgggaaggggcggggcctcgggcggggccgccgtggggaggagggcggtgggaggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgaggtgggccagtccccagcagcagtggggctgggggcaggggagcaggggggcacgtaggcatcccccatgccaggcctgagccttgctgtctctaccaccccagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctgaaaaaaaaaaaaaaaaaaaaaaaaaaa

SEQ ID NO: 148 - protein, 357 aa, Homo sapiens
  GenBank Accession No. NP_001035145.1
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEVGQSPAAVGLGAGEQGGT

SEQ ID NO: 149 - DNA, 1770 bp, Homo sapiens
  GenBank Accession No. NM_001109891.1
ctggcgcgcgcggccctgcgggtgacaggcaggcgggaaggggcggggcctcgggcggggccgccgtggggaggagggcggtgggaggggaggagtggagatggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctggcccttgacctgctggaccggatgttaacctttaaccccaataaacggatcacagtggaggaagcgctggctcacccctacctggagcagtactatgacccgacggatgagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggacctgcctcctgcctgcccctctcccgccagactgttagaaaatggacactgtgcccagcccggaccttggcagcccaggccggggtggagcatgggcctggccacctctctcctttgctgaggcctccagcttcaggcaggccaaggccttctcctccccacccgccctccccacggggcctcgggacctcaggtggccccagttcaatctcccgctgctgctgctgcgcccttaccttccccagcgtcccagtctctggcagttctggaatggaagggttctggctgccccaacctgctgaagggcagaggtggagggtggggggcgctgagtagggactcagggccatgcctgcccccctcatctcattcaaaccccaccctagtttccctgaaggaacattccttagtctcaagggctagcatccctgaggagccaggccgggccgaatcccctccctgtcaaagctgtcacttcgcgtgccctcgctgcttctgtgtgtggtgagcagaagtggagctggggggcgtggagagcccggcgcccctgccacctccctgacccgtctaatatataaatatagagatgtgtctatggctgaaaaaaaaaaaaaaaaaaaaaaaaaaa

SEQ ID NO: 150 - protein, 335 aa, Homo sapiens
  GenBank Accession No. NP_001103361.1
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILALDLLDRMLTFNPNKRITVEEALAHPYLEQYYDPTDEPVAEEPFTFAMELDDLPKERLKELIFQETARFQPGVLEAP

SEQ ID NO: 151 - DNA, 5916 bp, Homo sapiens
  GenBank Accession No. NM_002745.4
gcccctccctccgcccgcccgccggcccgcccgtcagtctggcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggacaagggctcagaggactggacgtgctcagacatcggtgttcttcttcccagttcttgacccctggtcctgtctccagcccgtcttggcttatccactttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcacctactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtgggtgtttcagtaaccacgttccatgcctgaggatttagcagagaggaacactgcgtctttaaatgagaaagtatacaattctttttccttctacagcatgtcagcatctcaagttcatttttcaacctacagtataacaatttgtaataaagcctccaggagctcatgacgtgaagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtaccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaatgcatttgtaattcatgaaaataaatgtacatcttctatcttcacattcatgttaagattcagtgttgctttcctctggatcagcgtgtctgaatggacagtcaggttcaggttgtgctgaacacagaaatgctcacaggcctcactttgccgcccaggcactggcccagcacttggatttacataagatgagttagaaaggtacttctgtagggtcctttttacctctgctcggcagagaatcgatgctgtcatgttcctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacgctcaccactcctgtggctgaggaaggatagctggctcatcctcggaaaacagacccacatctctattcttgccctgaaatacgcgcttttcacttgcgtgctcagagctgccgtctgaaggtccacacagcattgacgggacacagaaatgtgactgttaccggataacactgattagtcagttttcatttataaaaaagcattgacagttttattactcttgtttctttttaaatggaaagttactattataaggttaatttggagtcctcttctaaatagaaaaccatatccttggctactaacatctggagactgtgagctccttcccattccccttcctggtactgtggagtcagattggcatgaaaccactaacttcattctagaatcattgtagccataagttgtgtgctttttattaatcatgccaaacataatgtaactgggcagagaatggtcctaaccaaggtacctatgaaaagcgctagctatcatgtgtagtagatgcatcattttggctcttcttacatttgtaaaaatgtacagattaggtcatcttaattcatattagtgacacggaacagcacctccactatttgtatgttcaaataagctttcagactaatagcttttttggtgtctaaaatgtaagcaaaaaattcctgctgaaacattccagtcctttcatttagtataaaagaaatactgaacaagccagtgggatggaattgaaagaactaatcatgaggactctgtcctgacacaggtcctcaaagctagcagagatacgcagacattgtggcatctgggtagaagaatactgtattgtgtgtgcagtgcacagtgtgtggtgtgtgcacactcattccttctgctcttgggcacaggcagtgggtgtagaggtaaccagtagctttgagaagctacatgtagctcaccagtggttttctctaaggaatcacaaaagtaaactacccaaccacatgccacgtaatatttcagccattcagaggaaactgttttctctttatttgcttatatgttaatatggtttttaaattggtaacttttatatagtatggtaacagtatgttaatacacacatacatacgcacacatgctttgggtccttccataatacttttatatttgtaaatcaatgttttggagcaatcccaagtttaagggaaatatttttgtaaatgtaatggttttgaaaatctgagcaatccttttgcttatacatttttaaagcatttgtgctttaaaattgttatgctggtgtttgaaacatgatactcctgtggtgcagatgagaagctataacagtgaatatgtggtttctcttacgtcatccaccttgacatgatgggtcagaaacaaatggaaatccagagcaagtcctccagggttgcaccaggtttacctaaagcttgttgccttttcttgtgctgtttatgcgtgtagagcactcaagaaagttctgaaactgctttgtatctgctttgtactgttggtgccttcttggtattgtaccccaaaattctgcatagattatttagtataatggtaagttaaaaaatgttaaaggaagattttattaagaatctgaatgtttattcattatattgttacaatttaacattaacatttatttgtggtatttgtgatttggttaatctgtataaaaattgtaagtagaaaggtttatatttcatcttaattcttttgatgttgtaaacgtactttttaaaagatggattatttgaatgtttatggcacctgacttgtaaaaaaaaaaaactacaaaaaaatccttagaatcattaaattgtgtccctgtattaccaaaataacacagcaccgtgcatgtatagtttaattgcagtttcatctgtgaaaacgtgaaattgtctagtccttcgttatgttccccagatgtcttccagatttgctctgcatgtggtaacttgtgttagggctgtgagctgttcctcgagttgaatggggatgtcagtgctcctagggttctccaggtggttcttcagaccttcacctgtgggggggggggtaggcggtgcccacgcccatctcctcatcctcctgaacttctgcaaccccactgctgggcagacatcctgggcaaccccttttttcagagcaagaagtcataaagataggatttcttggacatttggttcttatcaatattgggcattatgtaatgacttatttacaaaacaaagatactggaaaatgttttggatgtggtgttatggaaagagcacaggccttggacccatccagctgggttcagaactaccccctgcttataactgcggctggctgtgggccagtcattctgcgtctctgctttcttcctctgcttcagactgtcagctgtaaagtggaagcaatattacttgccttgtatatggtaaagattataaaaatacatttcaactgttcagcatagtacttcaaagcaagtactcagtaaatagcaagtctttttaaa

SEQ ID NO: 152 - protein, 360 aa, Homo sapiens [sequence omitted]

SEQ ID NO: 153 - DNA, 1499 bp, Homo sapiens
  GenBank Accession No. NM_138957.2
gcccctccctccgcccgcccgccggcccgcccgtcagtctggcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggtacctggagtttaatacagtgagctctagcaagggaggcgctgccttttgtttctagaatattatgttcctcaaggtccattattttgtattcttttccaagctccttattggaaggtatttttttaaatttagaattaaaaattatttagaaagttacatataaa

SEQ ID NO: 154 - protein, 360 aa, Homo sapiens [sequence omitted]

SEQ ID NO: 155 - DNA, 4 bp, Artificial Sequence
  synthetic oligonucleotide
gtac

SEQ ID NO: 156 - DNA, 4 bp, Artificial Sequence
  synthetic oligonucleotide
catg

SEQ ID NO: 157 - DNA, 8481 bp, Homo sapiens
  GenBank Accession No. NM_004104.4
gagagacggcagcggccccggcctccctctccgccgcgcttcagcctcccgctccgccgcgctccagcctcgctctccgccgcccgcaccgccgcccgcgccctcaccagagcagccatggaggaggtggtgattgccggcatgtccgggaagctgccagagtcggagaacttgcaggagttctgggacaacctcatcggcggtgtggacatggtcacggacgatgaccgtcgctggaaggcggggctctacggcctgccccggcggtccggcaagctgaaggacctgtctaggtttgatgcctccttcttcggagtccaccccaagcaggcacacacgatggaccctcagctgcggctgctgctggaagtcacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaatgtcctgctgaagcccaacacctccgtgcagttcttgaggctggggatgctcagccccgagggcacctgcaaggccttcgacacagcggggaatgggtactgccgctcggagggtgtggtggccgtcctgctgaccaagaagtccctggcccggcgggtgtacgccaccatcctgaacgccggcaccaatacagatggcttcaaggagcaaggcgtgaccttcccctcaggggatatccaggagcagctcatccgctcgttgtaccagtcggccggagtggcccctgagtcatttgaatacatcgaagcccacggcacaggcaccaaggtgggcgacccccaggagctgaatggcatcacccgagccctgtgcgccacccgccaggagccgctgctcatcggctccaccaagtccaacatggggcacccggagccagcctcggggctggcagccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacgtgcacatcatcctgaggcccaacacgcagccgccccccgcacccgccccacatgccaccctgccccgtctgctgcgggccagcggacgcacccctgaggccgtgcagaagctgctggagcagggcctccggcacagccaggacctggctttcctgagcatgctgaacgacatcgcggctgtccccgccaccgccatgcccttccgtggctacgctgtgctgggtggtgagcgcggtggcccagaggtgcagcaggtgcccgctggcgagcgcccgctctggttcatctgctctgggatgggcacacagtggcgcgggatggggctgagcctcatgcgcctggaccgcttccgagattccatcctacgctccgatgaggctgtgaagccattcggcctgaaggtgtcacagctgctgctgagcacagacgagagcacctttgatgacatcgtccattcgtttgtgagcctgactgccatccagataggcctcatagacctgctgagctgcatggggctgaggccagatggcatcgtcggccactccctgggggaggtggcctgtggctacgccgacggctgcctgtcccaggaggaggccgtcctcgctgcctactggaggggacagtgcatcaaagaagcccatctcccgccgggcgccatggcagccgtgggcttgtcctgggaggagtgtaaacagcgctgccccccgggcgtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcctccgccgagtacaatgtcaacaacctggtgagccctgtgctgttccaggaggccctgtggcacgtgcctgagcacgcggtggtgctggagatcgcgccccacgccctgctgcaggctgtcctgaagcgtggcctgaagccgagctgcaccatcatccccctgatgaagaaggatcacagggacaacctggagttcttcctggccggcatcggcaggctgcacctctcaggcatcgacgccaaccccaatgccttgttcccacctgtggagttcccagctccccgaggaactcccctcatctccccactcatcaagtgggaccacagcctggcctgggacgtgccggccgccgaggacttccccaacggttcaggttccccctcagccgccatctacaacatcgacaccagctccgagtctcctgaccactacctggtggaccacaccctcgacggtcgcgtcctcttccccgccactggctacctgagcatagtgtggaagacgctggcccgcgccctgggcctgggcgtcgagcagctgcctgtggtgtttgaggatgtggtgctgcaccaggccaccatcctgcccaagactgggacagtgtccctggaggtacggctcctggaggcctcccgtgccttcgaggtgtcagagaacggcaacctggtagtgagtgggaaggtgtaccagtgggatgaccctgaccccaggctcttcgaccacccggaaagccccacccccaaccccacggagcccctcttcctggcccaggctgaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctgcccacccgtgtcaccgccatccacatcgaccctgccacccacaggcagaagctgtacacactgcaggacaaggcccaagtggctgacgtggtggtgagcaggtggctgagggtcacagtggccggaggcgtccacatctccgggctccacactgagtcggccccgcggcggcagcaggagcagcaggtgcccatcctggagaagttttgcttcactccccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggctggccacggtcacctgtattcccgcatcccaggcctgctcagcccccatcccctgctgcagctgagctacacggccaccgaccgccacccccaggccctggaggctgcccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcaccccctcggggacatcgtggccttcctcacctccactgagccgcagtatggccagggcatcctgagccaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcgggaaccgcctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccagggcgtacaggtgcaggtgtccaccagcaacatcagctcactggagggggcccggggcctcattgccgaggcggcgcagcttgggcccgtgggcggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcgagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccccaccccaccccaccccacccccgccatgcaacgggattgaagggtcctgccggtgggaccctgtccggcccagtgccactgccccccgaggctgctagatgtaggtgttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccgatgtcccctgcgggcgcgggcagccacccaagcctgctggctgcggccccctctcggccaggcattggctcagcccgctgagtggggggtcgtgggccagtccccgaggagctgggcccctgcacaggcacacagggcccggccacacccagcggccccccgcacagccacccgtggggtgctgcccttatgcccggcgccgggcaccaactccatgtttggtgtttgtctgtgtttgtttttcaagaaatgattcaaattgctgcttggattttgaaatttactgtaactgtcagtgtacacgtctggaccccgtttcatttttacaccaatttggtaaaaatgctgctctcagcctcccacaattaaaccgcatgtgatctccaaaaaaaaaaaaaaaaaaaaaaaa

SEQ ID NO: 158 - protein, 2511 aa, Homo sapiens
  GenBank Accession No. NP_004095.4
MEEVVIAGMSGKLPESENLQEFWDNLIGGVDMVTDDDRRWKAGLYGLPRRSGKLKDLSRFDASFFGVHPKQAHTMDPQLRLLLEVTYEAIVDGGINPDSLRGTHTGVWVGVSGSETSEALSRDPETLVGYSMVGCQRAMMANRLSFFFDFRGPSIALDTACSSSLMALQNAYQAIHSGQCPAAIVGGINVLLKPNTSVQFLRLGMLSPEGTCKAFDTAGNGYCRSEGVVAVLLTKKSLARRVYATILNAGTNTDGFKEQGVTFPSGDIQEQLIRSLYQSAGVAPESFEYIEAHGTGTKVGDPQELNGITRALCATRQEPLLIGSTKSNMGHPEPASGLAALAKVLLSLEHGLWAPNLHFHSPNPEIPALLDGRLQVVDQPLPVRGGNVGINSFGFGGSNVHIILRPNTQPPPAPAPHATLPRLLRASGRTPEAVQKLLEQGLRHSQDLAFLSMLNDIAAVPATAMPFRGYAVLGGERGGPEVQQVPAGERPLWFICSGMGTQWRGMGLSLMRLDRFRDSILRSDEAVKPFGLKVSQLLLSTDESTFDDIVHSFVSLTAIQIGLIDLLSCMGLRPDGIVGHSLGEVACGYADGCLSQEEAVLAAYWRGQCIKEAHLPPGAMAAVGLSWEECKQRCPPGVVPACHNSKDTVTISGPQAPVFEFVEQLRKEGVFAKEVRTGGMAFHSYFMEAIAPPLLQELKKVIREPKPRSARWLSTSIPEAQWHSSLARTSSAEYNVNNLVSPVLFQEALWHVPEHAVVLEIAPHALLQAVLKRGLKPSCTIIPLMKKDHRDNLEFFLAGIGRLHLSGIDANPNALFPPVEFPAPRGTPLISPLIKWDHSLAWDVPAAEDFPNGSGSPSAAIYNIDTSSESPDHYLVDHTLDGRVLFPATGYLSIVWKTLARALGLGVEQLPVVFEDVVLHQATILPKTGTVSLEVRLLEASRAFEVSENGNLVVSGKVYQWDDPDPRLFDHPESPTPNPTEPLFLAQAEVYKELRLRGYDYGPHFQGILEASLEGDSGRLLWKDNWVSFMDTMLQMSILGSAKHGLYLPTRVTAIHIDPATHRQKLYTLQDKAQVADVVVSRWLRVTVAGGVHISGLHTESAPRRQQEQQVPILEKFCFTPHTEEGCLSERAALQEELQLCKGLVQALQTKVTQQGLKMVVPGLDGAQIPRDPSQQELPRLLSAACRLQLNGNLQLELAQVLAQERPKLPEDPLLSGLLDSPALKACLDTAVENMPSLKMKVVEVLAGHGHLYSRIPGLLSPHPLLQLSYTATDRHPQALEAAQAELQQHDVAQGQWDPADPAPSALGSADLLVCNCAVAALGDPASALSNMVAALREGGFLLLHTLLRGHPLGDIVAFLTSTEPQYGQGILSQDAWESLFSRVSLRLVGLKKSFYGSTLFLCRRPTPQDSPIFLPVDDTSFRWVESLKGILADEDSSRPVWLKAINCATSGVVGLVNCLRREPGGNRLRCVLLSNLSSTSHVPEVDPGSAELQKVLQGDLVMNVYRDGAWGAFRHFLLEEDKPEEPTAHAFVSTLTRGDLSSIRWVCSSLRHAQPTCPGAQLCTVYYASLNFRDIMLATGKLSPDAIPGKWTSQDSLLGMEFSGRDASGKRVMGLVPAKGLATSVLLSPDFLWDVPSNWTLEEAASVPVVYSTAYYALVVRGRVRPGETLLIHSGSGGVGQAAIAIALSLGCRVFTTVGSAEKRAYLQARFPQLDSTSFANSRDTSFEQHVLWHTGGKGVDLVLNSLAEEKLQASVRCLATHGRFLEIGKFDLSQNHPLGMAIFLKNVTFHGVLLDAFFNESSADWREVWALVQAGIRDGVVRPLKCTVFHGAQVEDAFRYMAQGKHIGKVVVQVLAEEPEAVLKGAKPKLMSAISKTFCPAHKSYIIAGGLGGFGLELAQWLIQRGVQKLVLTSRSGIRTGYQAKQVRRWRRQGVQVQVSTSNISSLEGARGLIAEAAQLGPVGGVFNLAVVLRDGLLENQTPEFFQDVCKPKYSGTLNLDRVTREACPELDYFVVFSSVSCGRGNAGQSNYGFANSAMERICEKRRHEGLPGLAVQWGAIGDVGILVETMSTNDTIVSGTLPQRMASCLEVLDLFLNQPHMVLSSFVLAEKAAAYRDRDSQRDLVEAVAHILGIRDLAAVNLDSSLADLGLDSLMSVEVRQTLERELNLVLSVREVRQLTLRKLQELSSKADEASELACPTPKEDGLAQQQTQLNLRSLLVNPEGPTLMRLNSVQSSERPLFLVHPIEGSTTVFHSLASRLSIPTYGLQCTRAAPLDSIHSLAAYYIDCIRQVQPEGPYRVAGYSYGACVAFEMCSQLQAQQSPAPTHNSLFLFDGSPTYVLAYTQSYRAKLTPGCEAEAETEAICFFVQQFTDMEHNRVLEALLPLKGLEERVAAAVDLIIKSHQGLDRQELSFAARSFYYKLRAAEQYTPKAKYHGNVMLLRAKTGGAYGEDLGADYNLSQVCDGKVSVHVIEGDHRTLLEGSGLESIISIIHSSLAEPRVSVREG

SEQ ID NO: 159 - DNA, 2562 bp, Homo sapiens
  GenBank Accession No. NM_001654.4
cttgacagacgtgaccctgacccaataagggtggaaggctgagtcccgcagagccaataacgagagtccgagaggcgacggaggcggactctgtgaggaaacaagaagagaggcccaagatggagacggcggcggctgtagcggcgtgacaggagccccatggcacctgcccagccccacctcagcccatcttgacaaaatctaaggctccatggagccaccacggggcccccctgccaatggggccgagccatcccgggcagtgggcaccgtcaaagtatacctgcccaacaagcaacgcacggtggtgactgtccgggatggcatgagtgtctacgactctctagacaaggccctgaaggtgcggggtctaaatcaggactgctgtgtggtctaccgactcatcaagggacgaaagacggtcactgcctgggacacagccattgctcccctggatggcgaggagctcattgtcgaggtccttgaagatgtcccgctgaccatgcacaattttgtacggaagaccttcttcagcctggcgttctgtgacttctgccttaagtttctgttccatggcttccgttgccaaacctgtggctacaagttccaccagcattgttcctccaaggtccccacagtctgtgttgacatgagtaccaaccgccaacagttctaccacagtgtccaggatttgtccggaggctccagacagcatgaggctccctcgaaccgccccctgaatgagttgctaaccccccagggtcccagcccccgcacccagcactgtgacccggagcacttccccttccctgccccagccaatgcccccctacagcgcatccgctccacgtccactcccaacgtccatatggtcagcaccacggcccccatggactccaacctcatccagctcactggccagagtttcagcactgatgctgccggtagtagaggaggtagtgatggaaccccccgggggagccccagcccagccagcgtgtcctcggggaggaagtccccacattccaagtcaccagcagagcagcgcgagcggaagtccttggccgatgacaagaagaaagtgaagaacctggggtaccgggactcaggctattactgggaggtaccacccagtgaggtgcagctgctgaagaggatcgggacgggctcgtttggcaccgtgtttcgagggcggtggcatggcgatgtggccgtgaaggtgctcaaggtgtcccagcccacagctgagcaggcccaggctttcaagaatgagatgcaggtgctcaggaagacgcgacatgtcaacatcttgctgtttatgggcttcatgacccggccgggatttgccatcatcacacagtggtgtgagggctccagcctctaccatcacctgcatgtggccgacacacgcttcgacatggtccagctcatcgacgtggcccggcagactgcccagggcatggactacctccatgccaagaacatcatccaccgagatctcaagtctaacaacatcttcctacatgaggggctcacggtgaagatcggtgactttggcttggccacagtgaagactcgatggagcggggcccagcccttggagcagccctcaggatctgtgctgtggatggcagctgaggtgatccgtatgcaggacccgaacccctacagcttccagtcagacgtctatgcctacggggttgtgctctacgagcttatgactggctcactgccttacagccacattggctgccgtgaccagattatctttatggtgggccgtggctatctgtccccggacctcagcaaaatctccagcaactgccccaaggccatgcggcgcctgctgtctgactgcctcaagttccagcgggaggagcggcccctcttcccccagatcctggccacaattgagctgctgcaacggtcactccccaagattgagcggagtgcctcggaaccctccttgcaccgcacccaggccgatgagttgcctgcctgcctactcagcgcagcccgccttgtgccttaggccccgcccaagccaccagggagccaatctcagccctccacgccaaggagccttgcccaccagccaatcaatgttcgtctctgccctgatgctgcctcaggatcccccattccccaccctgggagatgagggggtccccatgtgcttttccagttcttctggaattgggggacccccgccaaagactgagccccctgtctcctccatcatttggtttcctcttggctttggggatacttctaaattttgggagctcctccatctccaatggctgggatttgtggcagggattccactcagaacctctctggaatttgtgcctgatgtgccttccactggattttggggttcccagcaccccatgtggattttggggggtcccttttgtgtctcccccgccattcaaggactcctctctttcttcaccaagaagcacagaattctgctgggcctttgcttgtttaaaaaaaaaaaaaaaaaaaaaaaaaaaaaaaaaaaaaaaaaaaaaaaaaaaaaaaaaaaaaaaaaaa

SEQ ID NO: 160 - protein, 606 aa, Homo sapiens [sequence omitted]

SEQ ID NO: 161 - DNA, 2571 bp, Homo sapiens
  GenBank Accession No. NM_001256196.1
cttgacagacgtgaccctgacccaataagggtggaaggctgagtcccgcagagccaataacgagagtccgagaggcgacggaggcggactctgtgaggaaacaagaagagaggcccaagatggagacggcggcggctgtagcggcgtgacaggagccccatggcacctgcccagccccacctcagcccatcttgacaaaatctaaggctccatggagccaccacggggcccccctgccaatggggccgagccatcccgggcagtgggcaccgtcaaagtatacctgcccaacaagcaacgcacggtggtgactgtccgggatggcatgagtgtctacgactctctagacaaggccctgaaggtgcggggtctaaatcaggactgctgtgtggtctaccgactcatcaagggacgaaagacggtcactgcctgggacacagccattgctcccctggatggcgaggagctcattgtcgaggtccttgaagatgtcccgctgaccatgcacaattttgtacggaagaccttcttcagcctggcgttctgtgacttctgccttaagtttctgttccatggcttccgttgccaaacctgtggctacaagttccaccagcattgttcctccaaggtccccacagtctgtgttgacatgagtaccaaccgccaacagccctcaaggttctaccacagtgtccaggatttgtccggaggctccagacagcatgaggctccctcgaaccgccccctgaatgagttgctaaccccccagggtcccagcccccgcacccagcactgtgacccggagcacttccccttccctgccccagccaatgcccccctacagcgcatccgctccacgtccactcccaacgtccatatggtcagcaccacggcccccatggactccaacctcatccagctcactggccagagtttcagcactgatgctgccggtagtagaggaggtagtgatggaaccccccgggggagccccagcccagccagcgtgtcctcggggaggaagtccccacattccaagtcaccagcagagcagcgcgagcggaagtccttggccgatgacaagaagaaagtgaagaacctggggtaccgggactcaggctattactgggaggtaccacccagtgaggtgcagctgctgaagaggatcgggacgggctcgtttggcaccgtgtttcgagggcggtggcatggcgatgtggccgtgaaggtgctcaaggtgtcccagcccacagctgagcaggcccaggctttcaagaatgagatgcaggtgctcaggaagacgcgacatgtcaacatcttgctgtttatgggcttcatgacccggccgggatttgccatcatcacacagtggtgtgagggctccagcctctaccatcacctgcatgtggccgacacacgcttcgacatggtccagctcatcgacgtggcccggcagactgcccagggcatggactacctccatgccaagaacatcatccaccgagatctcaagtctaacaacatcttcctacatgaggggctcacggtgaagatcggtgactttggcttggccacagtgaagactcgatggagcggggcccagcccttggagcagccctcaggatctgtgctgtggatggcagctgaggtgatccgtatgcaggacccgaacccctacagcttccagtcagacgtctatgcctacggggttgtgctctacgagcttatgactggctcactgccttacagccacattggctgccgtgaccagattatctttatggtgggccgtggctatctgtccccggacctcagcaaaatctccagcaactgccccaaggccatgcggcgcctgctgtctgactgcctcaagttccagcgggaggagcggcccctcttcccccagatcctggccacaattgagctgctgcaacggtcactccccaagattgagcggagtgcctcggaaccctccttgcaccgcacccaggccgatgagttgcctgcctgcctactcagcgcagcccgccttgtgccttaggccccgcccaagccaccagggagccaatctcagccctccacgccaaggagccttgcccaccagccaatcaatgttcgtctctgccctgatgctgcctcaggatcccccattccccaccctgggagatgagggggtccccatgtgcttttccagttcttctggaattgggggacccccgccaaagactgagccccctgtctcctccatcatttggtttcctcttggctttggggatacttctaaattttgggagctcctccatctccaatggctgggatttgtggcagggattccactcagaacctctctggaatttgtgcctgatgtgccttccactggattttggggttcccagcaccccatgtggattttggggggtcccttttgtgtctcccccgccattcaaggactcctctctttcttcaccaagaagcacagaattctgctgggcctttgcttgtttaaaaaaaaaaaaaaaaaaaaaaaaaaaaaaaaaaaaaaaaaaaaaaaaaaaaaaaaaaaaaaaaaaa

SEQ ID NO: 162 - protein, 609 aa, Homo sapiens
  GenBank Accession No. NP_001243125.1
MEPPRGPPANGAEPSRAVGTVKVYLPNKQRTVVTVRDGMSVYDSLDKALKVRGLNQDCCVVYRLIKGRKTVTAWDTAIAPLDGEELIVEVLEDVPLTMHNFVRKTFFSLAFCDFCLKFLFHGFRCQTCGYKFHQHCSSKVPTVCVDMSTNRQQPSRFYHSVQDLSGGSRQHEAPSNRPLNELLTPQGPSPRTQHCDPEHFPFPAPANAPLQRIRSTSTPNVHMVSTTAPMDSNLIQLTGQSFSTDAAGSRGGSDGTPRGSPSPASVSSGRKSPHSKSPAEQRERKSLADDKKKVKNLGYRDSGYYWEVPPSEVQLLKRIGTGSFGTVFRGRWHGDVAVKVLKVSQPTAEQAQAFKNEMQVLRKTRHVNILLFMGFMTRPGFAIITQWCEGSSLYHHLHVADTRFDMVQLIDVARQTAQGMDYLHAKNIIHRDLKSNNIFLHEGLTVKIGDFGLATVKTRWSGAQPLEQPSGSVLWMAAEVIRMQDPNPYSFQSDVYAYGVVLYELMTGSLPYSHIGCRDQIIFMVGRGYLSPDLSKISSNCPKAMRRLLSDCLKFQREERPLFPQILATIELLQRSLPKIERSASEPSLHRTQADELPACLLSAARLVP

SEQ ID NO: 163 - DNA, 1408 bp, Homo sapiens
  GenBank Accession No. NM_001256197.1
cttgacagacgtgaccctgacccaataagggtggaaggctgagtcccgcagagccaataacgagagtccgagaggcgacggaggcggactctgtgaggaaacaagaagagaggcccaagatggagacggcggcggctgtagcggcgtgacaggagccccatggcacctgcccagccccacctcagcccatcttgacaaaatctaaggctccatggagccaccacggggcccccctgccaatggggccgagccatcccgggcagtgggcaccgtcaaagtatacctgcccaacaagcaacgcacggtggtgactgtccgggatggcatgagtgtctacgactctctagacaaggccctgaaggtgcggggtctaaatcaggactgctgtgtggtctaccgactcatcaagggacgaaagacggtcactgcctgggacacagccattgctcccctggatggcgaggagctcattgtcgaggtccttgaagatgtcccgctgaccatgcacaattttgtacggaagaccttcttcagcctggcgttctgtgacttctgccttaagtttctgttccatggcttccgttgccaaacctgtggctacaagttccaccagcattgttcctccaaggtccccacagtctgtgttgacatgagtaccaaccgccaacagttctaccacagtgtccaggatttgtccggaggctccagacagcatgaggctccctcgaaccgccccctgaatgagttgctaaccccccagggtcccaggtagggatgccttagctgaagagctgctgggggagaaaaagatcttggggctcttgtagaccacgagccatactttattcatttgtttacttgacaaacatttattgagcacctacaagtgtgagtaagggcatgaaactgggaccttgggcaagtcacctcatttctctgggcctcagttttctcatctgtaaagaggggatgatgatactttctaccatataaaggttctggtgaggcttaaatgagttaagacatgttcagtgcctagaacaggatctggtacagtgtaaataatcaatttttttgttattaattataaatatatttataagcatctaactactttgctaattctagtataatcatactcaagcctttccattttgaaatacgtattattttatcataaattacttcccttttattgcttttttatgttaaatattatataaaactatagctatattaaaatatattattgctctaatatatattttatgatgtgcatattttatggtatatttatgttattgtatcatgttgtattacataattttatataatgtagaacatcatacatgtttatatgatacataaaataaagttagggtattattttaaaaaaaaaaaaaaaaaa

SEQ ID NO: 164 - protein, 186 aa, Homo sapiens
  GenBank Accession No. NP_001243126.1
MEPPRGPPANGAEPSRAVGTVKVYLPNKQRTVVTVRDGMSVYDSLDKALKVRGLNQDCCVVYRLIKGRKTVTAWDTAIAPLDGEELIVEVLEDVPLTMHNFVRKTFFSLAFCDFCLKFLFHGFRCQTCGYKFHQHCSSKVPTVCVDMSTNRQQFYHSVQDLSGGSRQHEAPSNRPLNELLTPQGPR

SEQ ID NO: 165 - DNA, 21 bp, Artificial Sequence
  synthetic oligonucleotide
cctgaaacttaagacagttaa

SEQ ID NO: 166 - DNA, 21 bp, Artificial Sequence
  synthetic oligonucleotide
cgtctctctatccaccgaatt

SEQ ID NO: 167 - DNA, 21 bp, Artificial Sequence
  synthetic oligonucleotide
cagggcattctcagtgtgatt

SEQ ID NO: 168 - DNA, 21 bp, Artificial Sequence
  synthetic oligonucleotide
gcagcgaatagctgaaagagt

SEQ ID NO: 169 - DNA, 21 bp, Artificial Sequence
  synthetic oligonucleotide
gcctgagaatatgaatggaat

SEQ ID NO: 170 - DNA, 21 bp, Artificial Sequence
  synthetic oligonucleotide
gcctacatcctgtccattcaa

SEQ ID NO: 171 - DNA, 21 bp, Artificial Sequence
  synthetic oligonucleotide
gcttcgaaactctggtgcata

SEQ ID NO: 172 - DNA, 21 bp, Artificial Sequence
  synthetic oligonucleotide
gctggtcgtttctccattaaa

SEQ ID NO: 173 - DNA, 21 bp, Artificial Sequence
  synthetic oligonucleotide
cccttgatgaagagggatcat

SEQ ID NO: 174 - DNA, 21 bp, Artificial Sequence
  synthetic oligonucleotide
cgtcgtctataccactgctta

SEQ ID NO: 175 - DNA, 21 bp, Artificial Sequence
  synthetic oligonucleotide
cgtctataccactgcttacta

SEQ ID NO: 176 - DNA, 21 bp, Artificial Sequence
  synthetic oligonucleotide
gctgcggaaacttcaggaaat

What is claimed is:

1. A method for treating a subject having a cancer comprising an oncogenic Kras mutation, the method comprising
   detecting that a sample obtained from the subject comprises an elevated level of expression of ribulose-5-phosphate-3-epimerase (RPE) compared to a control sample lacking an oncogenic Kras mutation, and
   inhibiting RPE or ribose 5-phosphate isomerase A (RPIA) in the subject, thereby treating the subject.

2. The method of claim 1, wherein said subject has been previously determined or is simultaneously determined to have a cancer comprising the oncogenic Kras mutation.

3. The method of claim 2, wherein said Kras mutation is selected from the group consisting of $Kras^{G12D}$, $Kras^{G12V}$, $Kras^{G13D}$, $Kras^{G12C}$, $Kras^{Q61R}$ $Kras^{Q61L}$, $Kras^{Q61K}$, $Kras^{G12R}$, and $Kras^{G12C}$.

4. The method of claim 1, wherein said cancer is selected from the group consisting of pancreatic cancer, non-small cell lung cancer, colorectal cancer, and biliary cancer.

5. A method comprising:
   (1) providing a sample from a subject, wherein the sample comprises an oncogenic Kras mutation;
   (2) detecting that said sample comprises an elevated level of expression of ribulose-5-phosphate-3-epimerase (RPE) compared to a control sample lacking the oncogenic Kras mutation, and
   (3) inhibiting RPE or ribose 5-phosphate isomerase A (RPIA) in the subject.

6. The method of claim 5, wherein said subject has been previously determined or is simultaneously determined to comprise an oncogenic Kras mutation.

7. The method of claim 6, wherein said Kras mutation is selected from the group consisting of $Kras^{G12D}$, $Kras^{G12V}$, $Kras^{G13D}$, $Kras^{G12C}$, $Kras^{Q61R}$, $Kras^{Q61L}$, $Kras^{Q61K}$, $Kras^{G12R}$, and $Kras^{G12C}$.

8. The method of claim 5, wherein the subject has pancreatic cancer, non-small cell lung cancer, colorectal cancer, or biliary cancer.

9. The method of claim 1, wherein RPE is inhibited by administering to the subject an antisense oligonucleotide that targets RPE or a small interfering RNA that targets RPE.

10. The method of claim 1, wherein RPIA is inhibited by administering to the subject an antisense oligonucleotide that targets RPIA or a small interfering RNA that targets RPIA.

11. The method of claim 5, wherein RPE is inhibited by administering to the subject an antisense oligonucleotide that targets RPE or a small interfering RNA that targets RPE.

12. The method of claim 5, wherein RPIA is inhibited by administering to the subject an antisense oligonucleotide that targets RPIA or a small interfering RNA that targets RPIA.

* * * * *